US006586568B1

(12) United States Patent
Simons et al.

(10) Patent No.: US 6,586,568 B1
(45) Date of Patent: *Jul. 1, 2003

(54) NON-A, NON-B, NON-C, NON-D, NON-E HEPATITIS REAGENTS AND METHODS FOR THEIR USE

(75) Inventors: John N. Simons, Grayslake, IL (US); Tami J. Pilot-Matias, Green Oaks, IL (US); George J. Dawson, Libertyville, IL (US); George G. Schlauder, Skokie, IL (US); Suresh M. Desai, Libertyville, IL (US); Thomas P. Leary, Kenosha, WI (US); Anthony Scott Muerhoff, Kenosha, WI (US); James Carl Erker, Hainesville, IL (US); Sheri L. Buijk, Round Lake, IL (US); Isa K. Mushahwar, Grayslake, IL (US)

(73) Assignee: Abbott Laboratories, Abbott Park, IL (US)

(*) Notice: This patent issued on a continued prosecution application filed under 37 CFR 1.53(d), and is subject to the twenty year patent term provisions of 35 U.S.C. 154(a)(2).

Subject to any disclaimer, the term of this patent is extended or adjusted under 35 U.S.C. 154(b) by 0 days.

(21) Appl. No.: 08/467,344

(22) Filed: Jun. 6, 1995

Related U.S. Application Data

(60) Division of application No. 08/424,550, filed as application No. PCT/US95/02118 on Feb. 14, 1995, now abandoned, which is a continuation-in-part of application No. 08/377,557, filed on Jan. 30, 1995, now abandoned, which is a continuation-in-part of application No. 08/344,185, filed on Nov. 23, 1994, now abandoned, and a continuation-in-part of application No. 08/344,190, filed on Nov. 23, 1994, now abandoned, each is a continuation-in-part of application No. 08/283,314, filed on Jul. 29, 1994, now abandoned, which is a continuation-in-part of application No. 08/242,654, filed on Mar. 13, 1994, now abandoned, which is a continuation-in-part of application No. 08/196,030, filed on Feb. 14, 1994, now abandoned.

(51) Int. Cl.[7] .................... C07K 7/00; C07K 7/04; C07K 7/06; A61K 39/29

(52) U.S. Cl. .............. 530/300; 530/324; 530/325; 530/326; 530/327; 530/328; 530/329; 530/330; 530/826; 424/185.1; 424/192.1; 424/204.1; 424/225.1

(58) Field of Search .................. 530/826, 300, 530/324–330; 424/185.1, 192.1, 204.1, 225.1

(56) References Cited

U.S. PATENT DOCUMENTS

| | | | |
|---|---|---|---|
| 4,743,535 A | 5/1988 | Carrico | |
| 4,876,187 A | 10/1989 | Duck et al. | |
| 5,275,947 A | 1/1994 | Arima et al. | |
| 5,399,346 A | 3/1995 | Anderson et al. | |
| 5,527,669 A | 6/1996 | Resnick et al. | |
| 5,576,302 A | 11/1996 | Cook et al. | |
| 5,824,507 A | * 10/1998 | Kim et al. | 435/69.3 |

FOREIGN PATENT DOCUMENTS

| | | |
|---|---|---|
| WO | 0318216 | 5/1989 |
| WO | 9000597 | 1/1990 |
| WO | 9408002 | 4/1994 |
| WO | 9418217 | 8/1994 |
| WO | 9532290 | 11/1995 |
| WO | 9532291 | 11/1995 |
| WO | 9532292 | 11/1995 |

OTHER PUBLICATIONS

Slater et al., "Developments in viral hepatitis during 1995", Exp. Opin. Ther. Patents; 6(8):739–746, 1996.*
Bowie et al., Science, 247:1306–1310, Mar. 1990.*
Geysen et al., Journal of Molecular Recognition, 1(1):32–41, 1988.*
Slater et al. Exp. Opin. Ther. patents 6(8):739–746, 1996.*
Database Medline on Dialog, 09474663, Holland DJ, Current Opinion in Pediatric, 10(1):34–40, Feb. 1998.*
Database Medline on Dialog, 08735860, Kilbourne ED, Mount Sanai Journal of Medicine, 63(3–4):159–66, May 1996.*
T. Peters et al., *Frequency of Hepatitis C in Acute Post–Transfusion Hepatitis After Open–Heart Surgery: A Prospective Study in 1,476 Patients, Journal of Medical Virology* vol. 39: 139–145 (1993).
R. Purcell, *The Discovery of the Hepatitis Viruses, Gastroenterology* vol. 104 No. 4: 955–963 (1993).
G. Dawson et al., *Solid–phase enzyme–linked immunosobent assay for hepatitis E virus IgG and IgM antibodies utilizing recombinant antigens and synthetic peptides, Journal of Virological Methods* vol. 38: 175–186 (1992).
P. Yarbough et al., *Hepatitis E Virus: Identification of Type–Common Epitopes, Journal of Virology* vol. 65 No. 11: p. 5790–5797 (1991).
H. Alter et al., Detection of Antibody to Hepatitis C Virus in Prospectively Followed Transfusion Recipients with Acute and Chronic Non–A, Non–B Hepatitis, *The New England Journal of Medicine* vol. 321 No. 22: p. 1494–1500 (1989).
M. Alter et al., Risk Factors for Acute Non–A, Non–B Hepatitis in the United States and Association With Hepatitis C Virus Infection, *JAMA* vol. 264 No. 17: p. 2231–2235 (1990).

(List continued on next page.)

Primary Examiner—Brenda Brumback
(74) Attorney, Agent, or Firm—Cheryl L. Becker; Dianne Casuto

(57) ABSTRACT

Hepatitis GB Virus (HGBV) nucleic acid and amino acid sequences useful for a variety of diagnostic and therapeutic applications, kits for using the HGBV nucleic acid or amino acid sequences, HGBV immunogenic particles, and antibodies which specifically bind to HGBV. Also provided are methods for producing antibodies, polyclonal or monoclonal, from the HGBV nucleic acid or amino acid sequences.

10 Claims, 49 Drawing Sheets

OTHER PUBLICATIONS

J. Dienstag, Hepatitis Non–A, Non–B: C at Last, *Gastroenterology* vol. 99 No. 4: p. 1177–1180 (1990).

G. Reyes et al., Isolation of a cDNA from the Virus Responsible for Enterically Transmitted Non–A, Non–B Hepatitis, *Science* vol. 247 : p. 1335–1339 (1990).

G. Kuo et al., An Assay for Circulating Antibodies to a Major Etiologic Virus of Human Non–A, Non–B Hepatitis, *Science* vol. 244 : p. 362–364 (1989).

A. Weiner et al., Detection of hepatitis C viral sequences in Non–A, non–B hepatitis, *The Lancet* vol. 335: p. 1–3 (1990).

G. Schlauder et al., Viraemia in Egyptian children with hepatitis E virus infection, *The Lancet* vol. 341: p. 378 (1993).

N. Lisitsyn et al., Cloning the Differences Between Two Complex Genomes, *Science* vol. 259: p. 946–951 (1993).

V. Thiers et al., Post–transfusional anti–HCV–negative non–A non–B hepatitis (II) serological and polymerase chain reaction analysis for hepatitis C and hepatitis B viruses, *Journal of Hepatology* vol. 18: p. 34–39 (1993).

Hepatitis C virus upstanding, *The Lancet* vol. 335: p. 1431–1432 (1990).

W. Parks et al., Attempted Isolation of Hepatitis Viruses in Marmosets, *The Journal of Infectious Diseases* vol. 120 No. 5: 539–547 (1969).

A. Holmes et al., Specific Neutralization of Human Hepatitis Type A in Marmoset Monkeys, *Nature* vol. 243: p. 419–420 (1973).

P. Provost et al., Physical, Chemical and Morphologic Dimensions of Human Hepatitis A Virus Strain CR326 (38578), *Proceedings of the Society for Experimental Biology and Medicine* vol. 148: p. 532–539 (1975).

Q. Choo et al., Isolation of a cDNA Clone Derived from a Blood–Borne Non–A, Non–B Viral Hepatitis Genome, *Science* vol. 244: p. 359–361 (1989).

J. Almeida et al., Morphology of the GB hepatitis agent, *Nature* vol. 261: p. 608–609 (1976).

F. Deinhardt et al., Studies on the Transmission of Human Viral Heptitis to Marmoset Monkeys, *Journal of Experimental Medicine* vol. 125: p. 673–688, Plate 81–86 (1966).

J. Dienstag, Non–A, Non–B Hepatitis, II. Experimental Transmission, Putative Virus Agents and Markers, and Prevention, *Gastroenterology* vol. 85 No. 3: p. 743–768 (1983).

F. Hollinger et al., Transfusion–Transmitted Viruses Study: Experimental Evidence for Two Non–A, Non–B Hepatitis Agents, *Journal of Infectious Diseases* vol. 142 No. 3: p. 400–407 ( 1980).

D. Bradley, Transmission, Etiology, and Pathogenesis of Viral Hepatitis Non–A, Non–B in Non–Human Primates, *Advances in Hepatitis Research*: p. 268–280 (1984).

F. Deinhardt et al., Hepatitis in marmosets, *The American Journal of the Medical Sciences* vol. 270: p. 73–80 (1975).

S. Kalter, Comparison of Infectivity of Human Non–A/Non–B Hepatitis and the GB Hepatitis Agent in Marmosets, *Viral and Immunological Diseases in Nonhuman Primates*;: p. 221–224 (1983).

E. Tabor et al., Transmission of Human Non–A, Non–B Hepatitis to Chimpanzees Following Failure to Transmit GB Agent Hepatitis, *Journal of Medical Virology*: p. 103–108 (1980).

D. Bradley et al. , Posttransfusion Non–A, Non–B Hepatitis: Physicochemical Properties of Two Distinct Agents, *The Journal of Infectious Diseases* vol. 148 No. 2: p. 254–265 (1983).

J. Dienstag, Virus–like particles and GB agent hepatitis, *Nature* vol. 264: p. 260–261 (1976).

P. Karayiannis et al., Studies of GB Hepatitis Agent in Tamarins, *Hepatology* vol. 9 No. 2: p. 186–192 (1989).

J. Melnick, Classification of Hepatitis A Virus as Enterovirus Type 72 and of Hepatitis B Virus as Hepadnavirus Type 1, *Intervirology* vol. 18: p. 105–106 (1982).

W. Parks et al., Characterization of Marmoset Hepatitis Virus, *The Journal of Infectious Diseases* vol. 120 No. 5: p. 548–559 (1969).

S. Feinstone et al., Hepatitis A: Detection by Immune Electron Microscopy of a Viruslike Antigen Associated with Acute Illness, *Science* vol. 182: p. 1026–1028 (1973).

E. Tabor et al., Lack of Susceptibility of Marmosets to Human Non–A, Non–B Hepatitis, *The Journal of Infectious Diseases* vol. 140 No. 5: p. 794–797 (1979).

E. Fagan et al., Toga Virus–Like Particles in Acute Liver Failure Attributed to Sporadic Non–A, Non–B Hepatitis and Recurrence After Liver Transplantation, *Journal of Medical Virology* vol. 38: p. 71–77 (1992).

J. Dienstag, Virus particles in marmoset hepatitis, *Nature* vol. 267: p. 729–730 (1977).

F. Deinhardt et al., Hepatitis in Marmosets, *The Journal of Infectious Diseases* vol. 121 No. 3: p. 351–354 (1970).

F. Deinhardt et al., The Mythology of Various Hepatitis A Virus Isolates, *International Symposium on Viral Hepatitis*: p. 390–404 (1975).

M. Alter et al., The Natural History of Community–Acquired Hepatitis C in the United States, *The New England Journal of Medicine* vol. 327 No. 27: p. 1899–1905 (1992).

R. Gibbs, Polymerase chain reaction techniques, *Analytical Biotechnology*: p. 69–75 (1991).

S. Friedman et al., The core element of the EcoRII methylase as defined by protease digestion and deletion analysis, *Nucleic Acids Research* vol. 19 No. 19: p. 5403–5408 (1991).

A. Rosenthal et al., Genomic walking and sequencing by oligo–cassette mediated polymerase chain reaction, *Nucleic Acids Research* vol. 18 No. 10: p. 3095–3096 (1990).

A. Akowitz, Protected endogenous retroviral sequences copurify with infectivity in experimental Creutzfeldt–Jakob disease, *Archives of Virology* vol. 130: p. 301–316 (1993).

Non–A, Non–B?, *The Lancet* vol. 2: p. 64–65 (1975).

F. Hollinger, Non–A, Non–B Hepatitis Viruses, *Virology* : p. 2239–2273 (1990).

J. Dienstag, Non–A, Non–B Hepatitis I. Recognition, Epidemiology, and Clinical Features, *Gastroenterology* vol. 85 No. 2: p. 439–462 (1983).

J. Strauss et al., Structure and Function of the Flavivirus and Pestivirus Genomes, *Viral Hepatitis and Liver Disease*: p. 333–344 (1990).

H. Alter et al., Posttransfusion Hepatitis After Exclusion of Commercial and Hepatitis–B Antigen–Positive Donors, *Annals of Internal Medicine* vol. 77 No. 5: p. 691–699 (1972).

H. Alter et al., Clinical and Serological Analysis of Transfusion–Associated Hepatitis, *The Lancet*: p. 838–841 (1975).

S. Feinstone et al., Transfusion–Associated Hepatitis Not Due To Viral Hepatitis Type A or B, *The New England Journal of Medicine* vol. 292 No. 15: p. 767–770 (1975).

J. Simons et al., Identification of two flavivirus–like genomes in the GB Hepatitis agent, *Proc. Natl. Acad. Sci. USA* vol. 92: p. 3401–3405 (1995).

J. Simons et al., Isolation of novel virus–like sequences associated with human hepatitis, *Nature Medicine* vol. 1 No. 6: p. 564–568 (1995).

G. Schlauder et al., Molecular and Serologic Analysis in the Transmission of the GB Hepatitis Agents, *Journal of Medical Virology* vol. 46: p. 81–90 (1995).

M. Yoshiba et al., Detection of the GBV–C hepatitis virus genome in serum from patients with fulminant hepatitis of unknown aetiology, *The Lancet* vol. 346: p. 1131–1132 (1995).

J. Linnen et al., Molecular Cloning and Disease Association of Hepatitis G Virus: A Transfusion–Transmissible Agent, *Science* vol. 271: p. 505–508 (1996).

A. Zuckerman, The new GB hepatitis viruses, *The Lancet* vol. 345: p. 1453–1455 (1995).

L. Altman, Three Newly Discovered Viruses May Cause Unexplained Hepatitis, *The New York Times Medical Science*, Apr. 11, 1995.

L. Altman, Newly Found Viruses May Cause Hepatitis, *The New York Times Medical Science*, Apr. 10, 1995.

T. Leary et al., Sequence and Genomic Organization of GBV–C: A novel Member of the Flaviviridae Associated With Human Non–A–E Hepetitis, *Journal of Medical Virology* vol. 48: p. 80–87 (1996).

G. Caetano–Anolles et al., DNA Amplification Fingerprinting Using Arbitrary Oligonucleotide Primers, *Applied Biochemistry and Biotechnology* vol. 42: p. 189–200 (1993).

B. Bassam, DNA amplification fingerprinting of bacteria, *Applied Microbiology and Biotechnology* vol. 38: p. 70–76 (1992).

G. Caetano–Anolles et al., DNA Amplification Fingerprinting Using Very Short Arbitrary Oligonucleotide Primers, *Biotechnology* vol. 9: p. 553–557 (1991).

J. Welsh et al., Fingerprinting genomes using PCR with arbitrary primers*, *Nucleic Acids Research* vol. 18 No. 24: p. 7213–7218 (1990).

J. Welsh et al., Arbitrarily primed PCR fingerprinting of RNA, *Nucleic Acids Research* vol. 20 No. 19: p. 4965–4970 (1992).

J. Williams et al., DNA polymorphisms amplified by arbitrary primers are useful as genetic markers, *Nucleic Acids Research* vol. 18 No. 22: p. 6531–6535 (1990).

P. Liang et al., Differential Display of Eukaryotic Messenger RNA by Means of the Polymerase Chain Reaction, *Science* vol. 257: p. 967–971 (1992).

P. Liang et al., Distribution and cloning of eukaryotic mRNAs by means of differential display: refinements and optimization, *Nucleic Acids Research* vol. 21 No. 14: p. 3269–3275 (1993).

S. K. Kuwada et al., *The American Joural of Gastroenterology*, vol. 89, No. 1, pp 57–61 (1994).

A. S. Muerhoff et al., *Journal of Virological Methods*, vol. 62, No. 1, pp. 55–62 (1996).

P. Tijssen, "Practice and Theory of Enzyme Immunoassays" Elsevier, Amsterdam, pp. 333–340 (1985).

S. Vijayasarathy, *Nucleic Acids Research*, vol. 18, No. 10, pp. 296–2975 (1990).

A. Takamizawa et al., *Journal of Virology*, vol. 65, No. 3, pp. 1105–1113 (1991).

Choo et al., *Proc. Natl. Acad. Sci. USA*, vol. 88, pp. 2451–22455 (1991).

Okamoto et al., "Polyprotein precursor—hepatitis C virus", EMBL Sequence Accession No. S40770, Submitted Mar. 1992.

Okamoto et al., *Virology*, vol. 188, pp. 331–341 (1992).

T. Gura, "Antisense Has Growing Pains",*Science*, vol. 270, (1995), pp. 575–577.

D. Brown, "Gene Therapy 'Oversold' by Researchers, Journalists", *Washington Post*, (Dec. 8, 1995), pp. 1 & A22.

A.S. Muerhoff et al., "Genomic Organization of GB Viruses A and B: Two New Members of the Flaviviridae Associated with GB Agent Hepatitis", *Journal Of Virology*, vol. 69, No. 9, (1995), pp. 5621–5630.

S. Chan et al., Journal of General Virology, 73: 1131–1141 (1992).

* cited by examiner

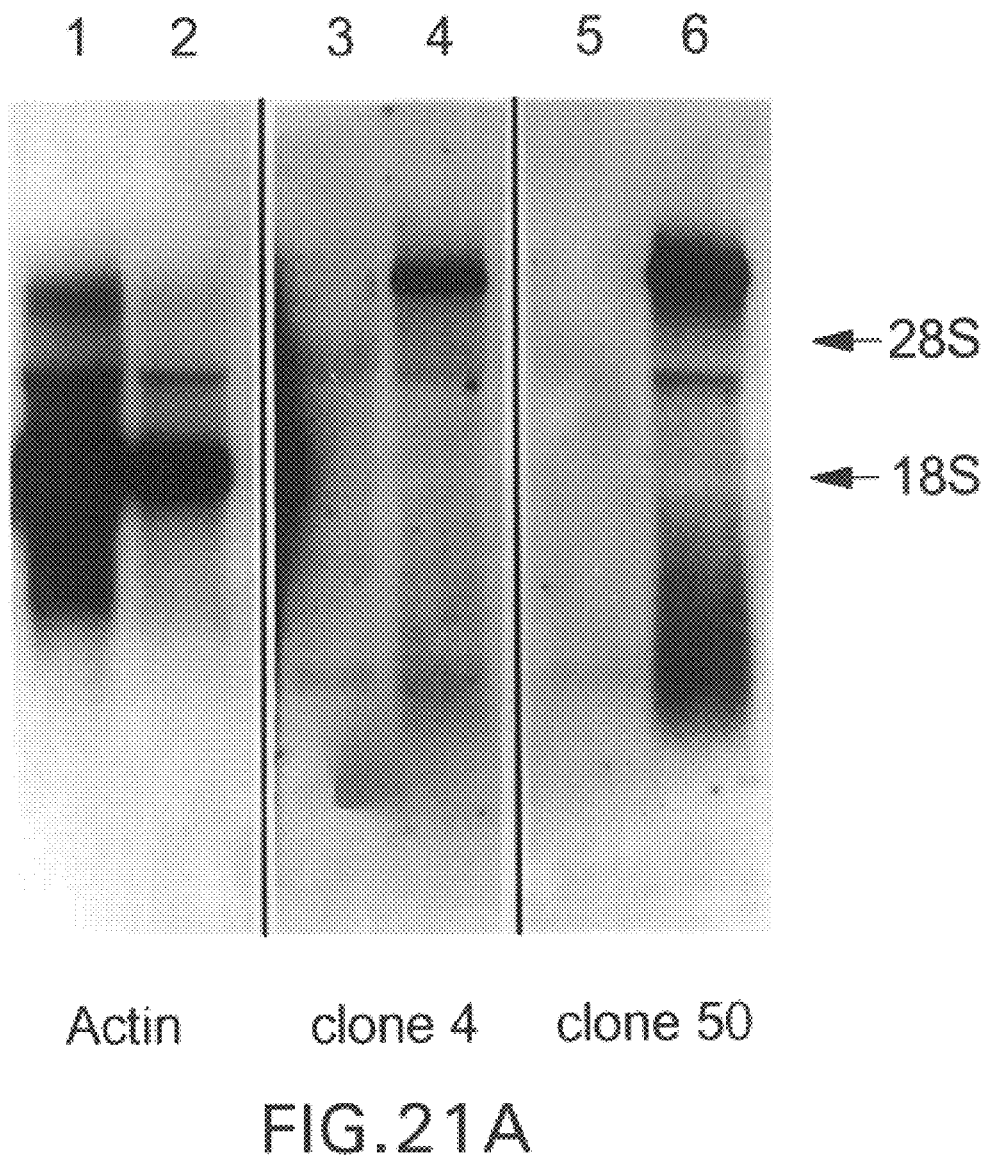

```
Contig B SEQ ID# 166(1297)  MYL..TGRCS RNYDVIICDE CHATDRTTVL GIGKVLTEAP SKNVRLVVLA
        SEQ ID# 179(1298)  KFLADGGCSG GAYDIIICDE CHSTDATSIL GIGTVLDQAE TAGARLVVLA
HCV-1
Contig A SEQ ID# 157(1407)  RFMANPRKYL RGNDVVICDE LHVTDPTSIL GMGRARLLAR ECGVRLLLFA
         Consensus          ---------- ---D--ICDE -H-TD-T--L G-G------A- ----RL---A
                                           **  *

Contig B SEQ ID# 166(1345)  TATPPGVIPT PHANITEIQL TDEGTIPFHG KKIKEENLKK GRHLIFEATK
HCV-1    SEQ ID# 179(1348)  TATPPGSVTV PHPNIEEVAL STTGEIPFYG KAIPLEVIKG GRHLIFCHSK
Contig A SEQ ID# 157(1457)  TATPPVSPMA KHESIHEEML GSEGEVPFYC QF

```
Contig B SEQ ID# 166(2599)  AAKLSDQHRA GIHTIARQYH AGGPMIAYDG REIGYRRCRS SGVYTTSSSN
HCV-1    SEQ ID# 180(2662)  CCDLDPQARV AIKSLTERLY VGGPLTNSRG ENCGYRRCRA SGVLTTSCGN
Contig A SEQ ID# 157(2798)  AA...SDNPS MVHALC.KKY SGGPMVSPDG VPLGYRQCRS SGVLTTSSAN
         Consensus          ........... .......... -GGP------G ---GYR-CR- SGV-TTS--N
                                                                *       *    *  *

Contig B SEQ ID# 166(2649)  SLTCWLKVNA AAEQAGMKNP RFLICGDDCT VIWKSAGADA DKQAMRVFAS
HCV-1    SEQ ID# 180(2712)  TLTCYIKARA ACRAAGLQDC TMLVCGDDLV VICESAGVQE DAASLRAFTE
Contig A SEQ ID# 157(2844)  SITCYIKVSA ACRRVGIKAP SFFIAGDDCL IIYENDGTDP CPALKAALAN
         Consensus          --TC--K--A A------G-- -------GDD-- -I-----G--- ----------
                                                            ***
```

FIG.24B

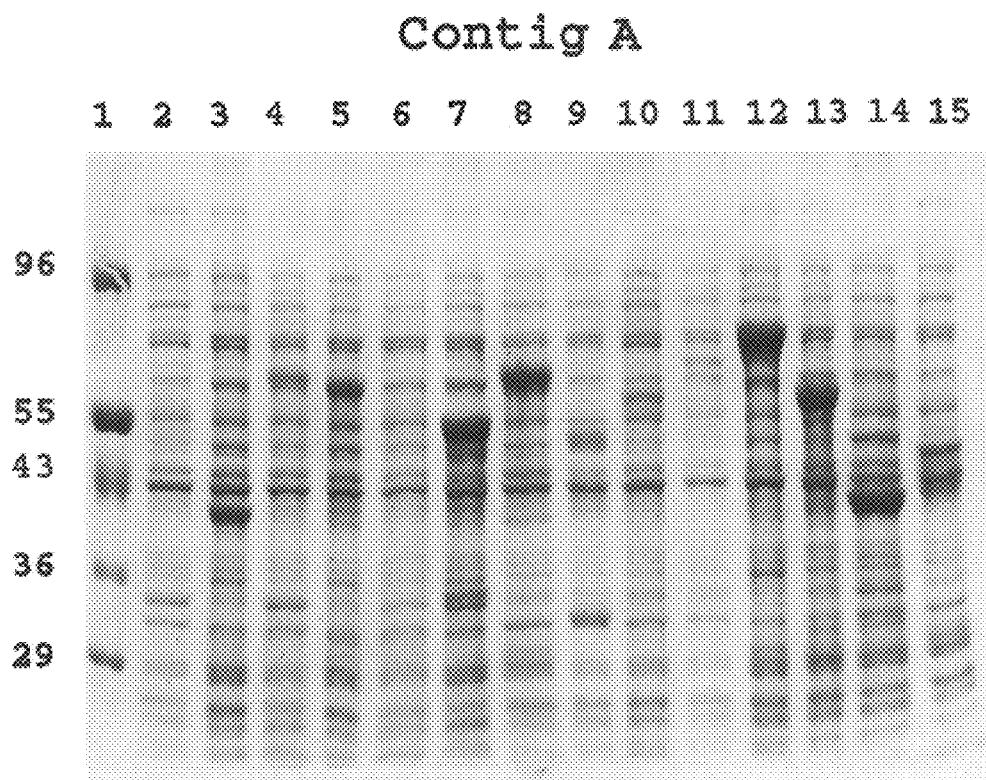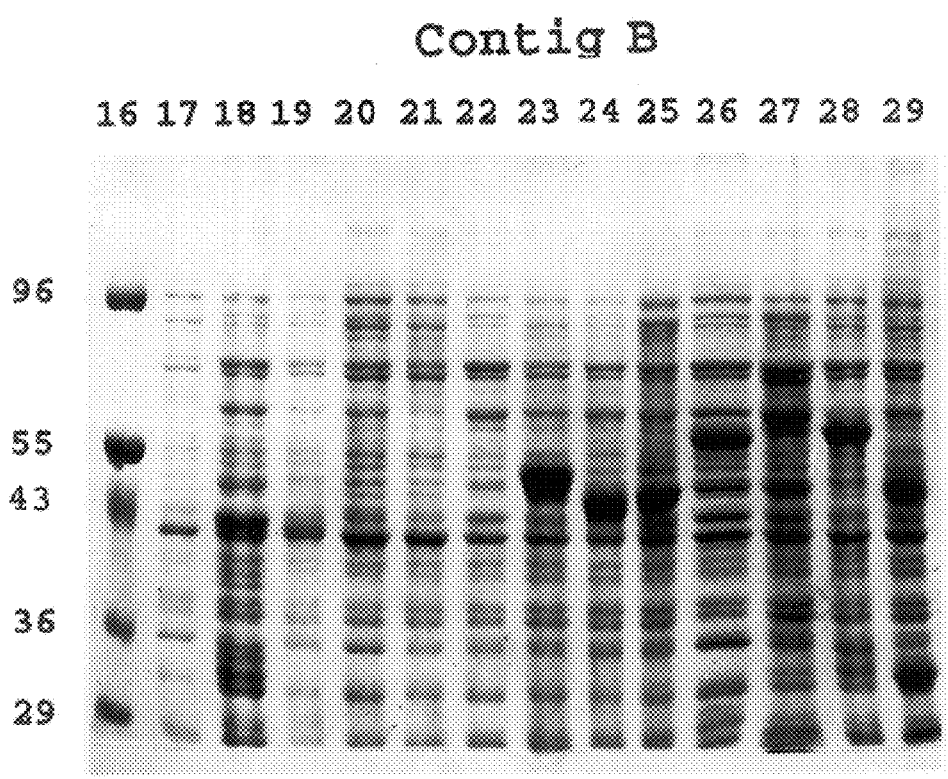
FIG.25A

Contig A
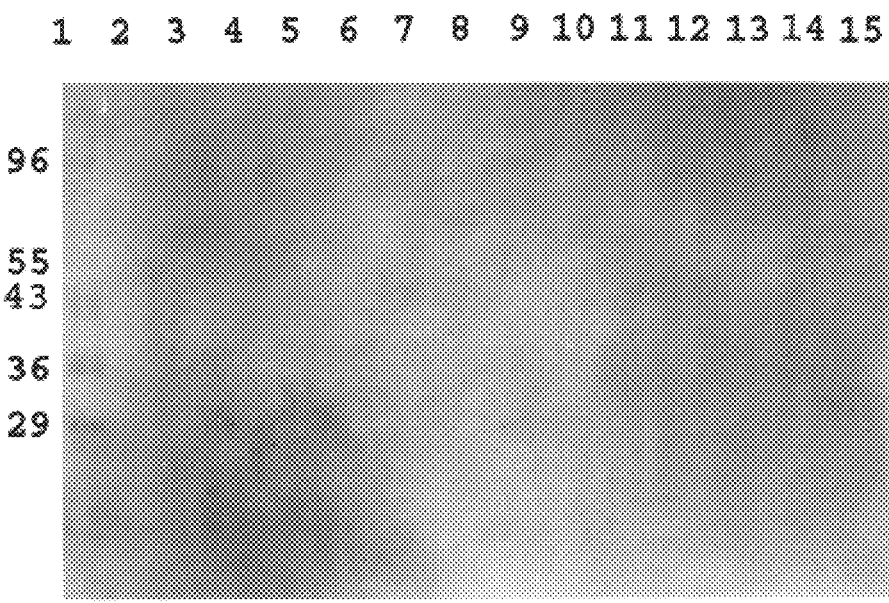
Contig B
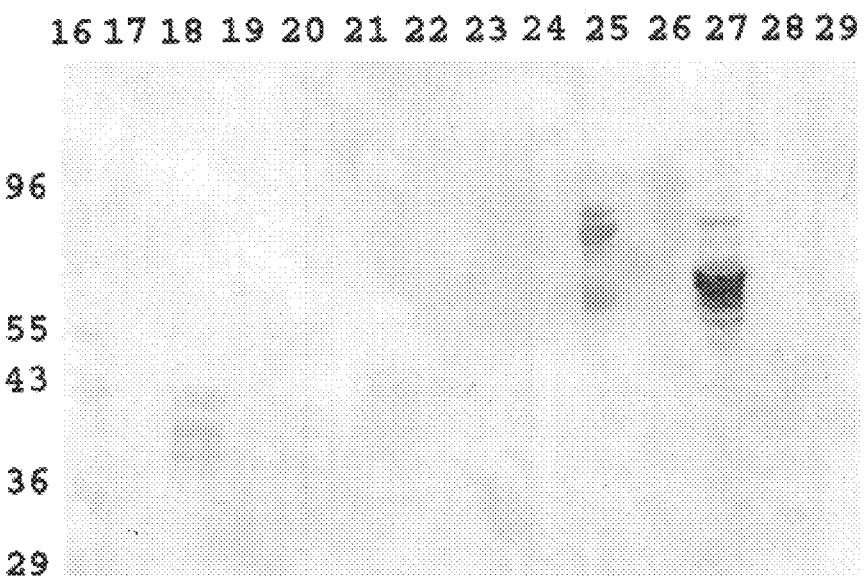
FIG.25B

```
Contig B SEQ ID# 166(1297)   MYL..TGRCS  RNYDVIICDE  CHATDRTTVL  GIGKVLTEAP  SKNVRLVVLA
   HCV-1 SEQ ID# 179(1298)   KFLADGGCSG  GAYDIIICDE  CHSTDATSIL  GIGTVLDQAE  TAGARLVVLA
Contig A SEQ ID# 157(1407)   RFMANPRKYL  RGNDVVICDE  LHVTDPTSIL  GMGRARLLAR  ECGVRLLLFA
                Consensus    ..........  ---D--ICDE  -H-TD-T--L  G-G-------  ---RL----A
                                              **  *

Contig B SEQ ID# 166(1345)   TATPPGVIPT  PHANITEIQL  TDEGTIPFHG  KKIKEENLKK  GRKLIFEATK
   HCV-1 SEQ ID# 179(1348)   TATPPGSVTV  PHPNIEEVAL  STTGEIPFYG  KAIPLEVIKG  GRHLIFCHSK
Contig A SEQ ID# 157(1457)   TATPPVSPMA  KHESIHEEML  GSEGEVPFYC  QFLPLSRYAT  GRHLLFCHSK
                Consensus    TATPP-----  -H--I-E--L  ---G--PF--  ..........  GRHL-F---K
                             ***  *

Contig B SEQ ID# 166(1395)   KHCDELANEL  ARKGITAVSY  YRGCDISKMP  .EGDCVVVAT  DALCTGYTGD
   HCV-1 SEQ ID# 179(1398)   KKCDELAAKL  VALGINAVAY  YRGLDVSVIP  TSGDVVVVAT  DALMTGYTGD
Contig A SEQ ID# 157(1507)   VECTRLSSAL  ASFGVNTVVY  FRGKETDI..  PTGDVCVCAT  DALSTGYTGN
                Consensus    --C--L---L  ----G--V-Y  -RG-------  --GD--V-AT  DAL-TGYTG-
                                                                    *

Contig B SEQ ID# 166(1444)   FDSVYDCSLM  VEGTCHVDLD  PTFTMGVRVC  GVSAIVKGQR  RGRTGRGRAG
   HCV-1 SEQ ID# 179(1448)   FDSVIDCNTC  VTQTVDFSLD  PTFTIETITL  PQDAVSRTQR  RGRTGRGKPG
Contig A SEQ ID# 157(1555)   FDTVTDCGLM  VEEVVEVTLD  PTITIGVKTV  PAPAELRAQR  RGRCGRGKAG
                Consensus    FD-V-DC---  V-------LD  PT-T------  ---A----QR  RGR-GRG--G
                                 *                                           *  ** **
```

FIG.35A

```
Contig B SEQ ID# 166(2599)    AAKLSDQHRA GIHTIARQYH AGGPMIAYDG REIGYRRCRS SGVYTTSSSN
        SEQ ID# 180(2662)    CCDLDPQARV AIKSLTERLY VGGPLTNSRG ENCGYRRCRA SGVLTTSCGN
HCV-1
Contig A SEQ ID# 152(2798)    AA...SDNPS MVHALC.KYY SGGPMVSPDG VPLGYRQCRS SGVLTTSSAN
        Consensus             ........   ........   -GGP----G   ---GYR-CR-  SGV-TTS--N
                                                                        *       *  *

Contig B SEQ ID# 166(2649)    SLTCWLKVNA AAEQAGMKNP RFLICGDDCT VIWKSAGADA DKQAMRVFAS
HCV-1    SEQ ID# 180(2712)    TLTCYIKARA ACRAAGLQDC TMLVCGDDLV VICESAGVQE DAASLRAFTE
Contig A SEQ ID# 157(2844)    SITCYIKVSA ACRRVGIKAP SFFIAGDDCL IIYENDGTDP CPALKAALAN
        Consensus             --TC--K--A A----G----  ----GDD--   -I----G---  ........
                                                           ***

FIG.35B
```

```
SEQ ID 76    agcCtActgC GActCCCCcg GGCtCgCCTA TGACTCAGCA tCCATCCATA aTTGAGACAA AgCTGGac.. .gTTGGTGAG ATCCCCTTTT ATGGGcaTGG
SEQ ID 37    TGCCTACGGC GACCCCACCG GTCTCTCCGA TGGCGAAGCA TGAATCTATT CATGAGGAGA TGTTGGGCAG TGAGGGGGAG GTCCCCTTCT ATTGCCAATT
SEQ ID 44    TTGCCACGGC tACCCCCCCT GGAGTAATCC CTACACCACA TgCCAacAta acTGAGATtC AATTAACCGA TGAAGGCACT ATcCCCTTTC ATGGAAAAAA
SEQ ID 100   TCGCCACTGC TACCCCTCCG GGCTCCGTCA CTGTGTCCCA TCCTAACATC GAGGAGGTTG CTCTGTCCAC CACCGGAGAG ATCCCCTTTT ACGGCAAGGC SEQ ID 76    TATCCCCCTc gAGcG.TATg aGGACTGGT. CGCCACCTTG TAtTCTGcca TtccaAGGGCG GAGTGCGAGA GatTGGCCGg CCAGTTCTCC GcgcGGgGGGG
SEQ ID 37    CCTCCCACTG AGTAGGTATG CTACTGGG... AGACACCTGC TGTTTTGTCA TTCCAAGGTA GArTGCACTA GGTTATCCTC AGCTTTTGGCC AGCTTTGGTG
SEQ ID 44    GATTAaGGAG GAAAATCTGA aGAAAGGG... AGACACCTTA TCTTTGAGGC TACCAAAAAA CACTGTGAtg AGCTtGCTAA CGAGTTAGCT CGAAAGGGAA
SEQ ID 100   TATCCCCCTC GAGGTGATCA AGGGGGA... AGACATCTCA TCTTCTGCCA CTCAAAGAAG AAGTGCGACG AGCTCGCCGC GAAGCTGGTC GCATTGGGCA SEQ ID 76    TtAATgCcAT CgcC.TATTA TAGGGGTAAG GACAGTTCCA TCATCAAAGa CGgAgacCTg GTGGtTTGTG .CGACAGACG .Cg.CTCTCT ACCGGGTACA
SEQ ID 37    TCAACACCGT TGTGTACTTC AGAGGCAAAG AA....ACTG ACATTCCAAC TGGTGACGTG TGCGTTTG... .CGCCACAGA CGCACTTTCC ACTGGTTACA
SEQ ID 44    TAACAGCTGT CtCTTAC.TA TAGGGATGGT GACATCTCAA AAATCC...C TGAGGGCGAc tGtGtaGTaG tTGccaCtGa TGCCTTgtGT aCagGGTaCa
SEQ ID 100   TCAATGCCGT GGCCTAC.TA CCCGCGGTCT GACGTGTCTG TCATCCCGAC CAGCGGCGAT GTTGTCGTCG TGTCGACCGA TGCTCTCATG ACTGGCTTTA SEQ ID 76    CAGgAAACTT CGATTCTGTC ACCGACTGTG GGtTGGTGGT GGAGGAGGTC GTTGAGGTGA CCCTtGatCC cACCaT
SEQ ID 37    CTGGCAATTT TGACACCGTA ACAGACTGTG GTTTAATGGT TGAGGAGGTA GTGGAAGTGA CCCTGGACCC GACCAT
SEQ ID 44    CTGGTGaCTT TGaTTCCGTG TaTGaCTGCa GcCTCaTgGT AGAaGGCaca TGCCaTGTTG aCCTTGaCCC TaCTTT
SEQ ID 100   CCGGCGACTT CGACTCTGTG ATAGACTGCA ACACGTGTGT CACTCAGACA GTCGATTTTA GCCCTTGACCC TACCTT
```

FIG.36

| | | | | | | | | | | | |
|---|---|---|---|---|---|---|---|---|---|---|---|
| SEQ ID 98 | ATC | CCC | TTT | TAT | GGG | CAT | ATA | CCC | CTG | GAG | AGG | ATG | CGG | ACC | GGC | AGG | CAC | CTC | GTA |
| SEQ ID 97 | ATC | CCC | TTT | TAT | GGG | CAT | GGA | ATC | CCC | CTC | GAG | ATG | CGG | ACC | GGG | CGC | CAC | CTC | GTG |
| SEQ ID 76 | ATC | CCC | TTT | TAT | GGG | CAT | GGT | ATC | CCC | GAG | ATG | CGG | AGG | ACT | GGT | CGC | CAC | CTT | GTA |
| Consensus | ATC | CCC | TTT | TAT | GGG | CAT | GG- | AT- | CCC | CT- | GAG | -G- | ATG | AC- | GG- | -G- | CAC | CT- | GT- |
| translat. | I | P | F | Y | G | H | | I | P | L | E | R | M | R | T | G | R | H | L | V |

| | | | | | | | | | | | |
|---|---|---|---|---|---|---|---|---|---|---|---|
| SEQ ID 98 | TTC | TGC | CAT | TCA | AAG | GCG | GAG | TGC | GAG | CTT | GCT | GGC | CAG | TTC | TCA | GCC | CGG | GGG | GTA |
| SEQ ID 97 | TTC | TGC | CAT | TCA | AAG | GCG | GAG | TGC | GAG | CGG | TTG | GCT | GGC | CAG | TTC | TCT | TCG | CGG | GGG | GTG |
| SEQ ID 76 | TTC | TGC | CAT | TCC | AAG | GCG | GAG | TGC | GAG | AGA | TTG | GCC | GGC | CAG | TTC | TCC | GCr | CGG | GGG | GTy |
| Consensus | TTC | TGC | CAT | TC- | AAG | GCG | GAG | TGC | GAG | -G- | -T- | GC- | GGC | CAG | TTC | TC- | -C- | CGG | GGG | GT- |
| translat. | F | C | H | S | K | A | E | C | E | R | L | A | G | Q | F | S | A/S | R | G | V |

| | | | | | | | | | | | |
|---|---|---|---|---|---|---|---|---|---|---|---|
| SEQ ID 98 | AAT | GCC | ATT | GCC | TAT | TAT | AGG | GGG | AAA | GAC | AGT | TCT |
| SEQ ID 97 | AAT | GCC | ATT | GCC | TAT | TAC | AGG | GGG | AAA | GAC | AGT | TCC |
| SEQ ID 76 | AAT | GCC | ATC | GCC | TAT | TAT | AGG | GGT | AAG | GAC | AGT | TCC |
| Consensus | AAT | GCC | AT- | GCC | TAT | TA- | AGG | GG- | AA- | GAC | AGT | TC- |
| translat. | N | A | N | A | Y | Y | R | G | K | D | S | S |

FIG. 38

```
   GB-C   T TAT GGG CAT GGT ATC CCC CTC GAG CGT ATG AGG ACT GGT CGC CAC
CTT GTA TTC TGC CAT TCC AAG GCG GAG TGC GAG AGA
GB-C.4   - --- --- --- --C --- --- --G --- --G --- --- --C --- A-G ---
--G --- --- --- --C --A --- --- --- --T --- --G
GB-C.5   - --- --- --- --C --A --T --- --A --G --- C-- --C --A A-G ---
--C --G --- --- --A --- --- --- --- --- C-G
GB-C.6   - --- --- --- --C --T --T --G --- --G --- CA- --C --- A-A --T
--- --G --- C-- --C --G --- --- --- --- --- C-G
GB-C.7   - --- --- --- --C --A --- --- --A --G --- C-A --C --A G-G ---
--C --G --- --T --- --- --- --- --- --- C-G

GB-C   TTG GCC GGC CAG TTC TCC GCG CGG GGG GTT AAT GCC ATC GCC TAT
TAT AGG GGT AAG GAC AGT TCC ATC ATC AAA GAC GGA GAC
GB-C.4   C-- --- --- --A --- --- T-A --- --- --- --- --T G-T --- ---
--- --- --- --- --- --- --A --- --- --G --T --T ---
GB-C.5   C-C --T --T --- --T --T --- A-- --- --A --C --- --T --T ---
--- --- --C --A --- --- --- --- --- --G --- --- ---
GB-C.6   C-T --- --- --- --- --- T-T A-- --- --C --C --- --T --- ---
--C --- --- --- --C --- --- --- --G --- --- ---
GB-C.7   C-T --T --- --- --- --T --- A-- --- --G --- --- --T --- ---
--- --- --C --A --- --- --- --G --T --C ---

GB-C   CTG GTG GTT TGT GCG ACA GAC GCG CTC TCT ACC
GB-C.4   --- --- --G --C --T --T --- --- --A --- ---
GB-C.5   --A --- --G --C --C --- --- --- --A --C --G
GB-C.6   --C --T --G --C --C --T --T --- --- --- --G
GB-C.7   --- --- --G --C --T --G C-- --- --A --C ---
```

FIG.40

NON-A, NON-B, NON-C, NON-D, NON-E HEPATITIS REAGENTS AND METHODS FOR THEIR USE

This application is a divisional of U.S. Ser. No. 08/424,550 filed Jun. 17, 1996 now abandoned, which is a 371 of PCT/US95/02118 filed Feb. 14, 1995, which is a continuation-in-part application of U.S. Ser. No. 08/377,557 filed Jan. 30, 1995, now abandoned, which is a continuation-in-part of U.S. Ser. No. 08/344,185 filed Nov. 23, 1994, now abandoned, and U.S. Ser. No. 08/344,190 filed Nov. 23, 1994, now abandoned, which are each continuation-in-part applications of Ser. No. 08/283,314 filed Jul. 29, 1994, now abandoned, which is a continuation-in-part application of U.S. Ser. No. 08/242,654, filed May 13, 1994, now abandoned, which is a continuation-in-part application of U.S. Ser. No. 08/196,030 filed Feb. 14, 1994, now abandoned, all of which enjoy common ownership and each of which is incorporated herein by reference.

BACKGROUND OF THE INVENTION

This invention relates generally to a group of infectious viral agents causing hepatitis in man, and more particularly, relates to materials such as polynucleotides derived from this group of viruses, polypeptides encoded therein, antibodies which specifically bind to these polypeptides, and diagnostics and vaccines that employ these materials.

Hepatitis is one of the most important diseases transmitted from a donor to a recipient by transfusion of blood products, organ transplantation and hemodialysis; it also can be transmitted via ingestion of contaminated food stuffs and water, and by person to person contact. Viral hepatitis is known to include a group of viral agents with distinctive viral genes and modes of replication, causing hepatitis with differing degrees of severity of hepatic damage through different routes of transmission. In some cases, acute viral hepatitis is clinically diagnosed by well-defined patient symptoms including jaundice, hepatic tenderness and an elevated level of liver transaminases such as aspartate transaminase (AST), alanine transaminase (ALT) and isocitrate dehydrogenase (ISD). In other cases, acute viral hepatitis may be clinically inapparent. The viral agents of hepatitis include hepatitis A virus (HAV), hepatitis B virus (HBV), hepatitis C virus (HCV), hepatitis delta virus (HDV), hepatitis E virus (HEV), Epstein-Barr virus (EBV) and cytomegalovirus (CMV).

Although specific serologic assays available by the late 1960's to screen blood donations for the presence of HBV surface antigen (HBsAg) were successful in reducing the incidence of post-transfusion hepatitis (PTH) in blood recipients, PTH continued to occur at a significant rate. H. J. Alter et al., *Ann. Int. Med.* 77:691–699 (1972); H. J. Alter et al., *Lancet* ii:838–841 (1975). Investigators began to search for a new agent, termed "non-A, non-B hepatitis" (NANBH), that caused viral hepatitis not associated with exposure to viruses previously known to cause hepatitis in man (HAV, HBV, CMV and EBV). See, for example, S. M. Feinstone et al., *New Engl. J. Med.* 292:767–770 (1975); Anonymous editorial, *Lancet* ii:64–65 (1975); F. B. Hollinger in B. N. Fields and D. M. Knipe et al., *Virology,* Raven Press, New York, pp. 2239–2273 (1990).

Several lines of epidemiological and laboratory evidence have suggested the existence of more than one parenterally transmitted NANB agent, including multiple attacks of acute NANBH in intravenous drug users; distinct incubation periods of patients acquiring NANBH post-transfusion; the outcome of cross-challenge chimpanzee experiments; the ultrastructural liver pathology of infected chimpanzees; and the differential resistance of the putative agents to chloroform. J. L. Dienstag, *Gastroenterology* 85:439–462 (1983); J. L. Dienstag, *Gastroenterology* 85:743–768 (1983); F. B. Hollinger et al., *J. Infect. Dis.* 142:400–407 (1980); D. W. Bradley in F. Chisari, ed., *Advances in Hepatitis Research,* Masson, New York, pp. 268–280 (1984); and D. W. Bradley et al., *J. Infect. Dis.* 148:254–265 (1983).

A serum sample obtained from a surgeon who had developed acute hepatitis was shown to induce hepatitis when inoculated into tamarins (Saguinus species). Four of four tamarins developed elevated liver enzymes within a few weeks following their inoculation, suggesting that an agent in the surgeon's serum could produce hepatitis in tamarins. Serial passage in various non-human primates demonstrated that this hepatitis was caused by a transmissable agent; filtration studies suggested the agent to be viral in nature. The transmissable agent responsible for these cases of hepatitis in the surgeon and tamarins was termed the "GB agent." F. Deinhardt et al., *J. Exper. Med.* 125:673–688 (1967). F. Dienhardt et al., *J. Exper. Med.,* supra; E. Tabor et al., *J. Med. Virol.* 5: 103–108 (1980); R. O. Whittington et al., *Viral and Immunological Diseases in Nonhuman Primates,* Alan R. Liss, Inc., New York, pp. 221–224 (1983).

Although it was suggested that the GB agent may be an agent causing NANBH in humans and that the GB agent was not related to the known NANBH agents studied in various laboratories, no definitive or conclusive studies on the GB agent are known, and no viral agent has been discovered or molecularly characterized. F. Deinhardt et al., *Am. J. Med. Sci.* 270:73–80 (1975); and J. L. Dienstag et al., *Nature* 264:260–261 (1976). See also E. Tabor et al., *J. Med. Virol., supra;* E. Tabor et al., *J. Infect. Dis.* 140:794–797 (1979); R. O. Whittington et al., supra; and P. Karayiannis et al., *Hepatology* 9:186–192 (1989).

Early studies indicated that the GB agent was unrelated to any known human hepatitis virus. S. M. Feinstone et al., *Science* 182:1026–1028 (1973); P. J. Provost et al., *Proc. Soc. Exp. Biol. Med.* 148:532–539 (1975); J. L. Melnick, *Intervirology* 18:105–106 (1982); A. W. Holmes et al., *Nature* 243:419–420 (1973); and F. Deinhardt et al., *Am. J. Med. Sci.,* supra. However, questions were raised regarding whether the GB agent was a virus which induced hepatitis infection in humans, or a latent tamarin virus activated by the GB serum and once activated, easily passaged to other tamarins, inducing hepatitis in them. Also, a small percentage of marmosets inoculated with GB-positive serum did not develop clinical hepatitis (4 of 52, or 7.6%), suggesting that these animals may have been naturally immune and thus, that the GB agent may be a marmoset virus. W. P. Parks et al., *J. Infect. Dis.* 120:539–547 (1969); W. P. Parks et al., *J. Infect. Dis.* 120:548–559 (1969). Morphological studies have been equivocal, with immune electron microscopy studies in one report indicating that the GB agent formed immune complexes with a size distribution of 20–22 nm and resembling the spherical structure of a parvovirus, while another study reported that immune electron microscopy data obtained from liver homogenates of GB-positive tamarins indicated that aggregares of 34–36 nm with icosahedral symmetry were detected, suggesting that the GB agent was a calici-like virus. See, for example, J. D. Almeida et al., *Nature* 261:608–609 (1976); J. L. Dienstag et al., *Nature,* supra.

Two hepatitis-causing viruses recently have been discovered and reported: HCV, which occurs primarily through parenteral transmission, and HEV, which is transmitted enterically. See, for example, Q. L. Choo et al., *Science* 244:359–362 (1989), G. Kuo et al., *Science* 244:362–364 (1989), E. P. Publication No. 0 318 216 (published May 31, 1989), G. R. Reyes et al., *Science* 247:1335–1339 (1990). HCV is responsible for a majority of PTH ascribed to the NANBH agent(s) and many cases of acute NANBH not acquired by transfusion. Anonymous editorial, *Lancet* 335:1431–1432 (1990); J. L. Dienstag, *Gastroenterology* 99:1177–1180 (1990); and M. J. Alter et al., *JAMA* 264:2231–2235 (1990).

While the detection of HCV antibody in donor samples eliminates 70 to 80% of NANBH infected blood in the blood supply system, the discovery and detection of HCV has not totally prevented the transmission of hepatitis. H. Alter et al., *New Eng. J. Med.* 321:1494–1500 (1989). Recent publications have questioned whether additional hepatitis agents may be responsible for PTH and for community acquired acute and/or chronic hepatits that is not associated with PTH. For example, of 181 patients monitored in a prospective clinical survery conducted in France from 1988 to 1990, investigators noted a total of 18 cases of PTH. Thirteen of these 18 patients tested negative for anti-HCV antibodies, HBsAg, HBV and HCV nucleic acids. The authors speculated as to the potential importance of a non-A, non-B, non-C agent causing PTH. V. Thiers et al., *J. Hepatology* 18:34–39 (1993). Also, of 1,476 patients monitored in another study conducted in Germany from 1985 to 1988, 22 cases of documented cases of PTH were not related to infection with HBV or HCV. T. Peters et al., *J. Med. Virol.* 39:139–145 (1993).

It would be advantageous to identify and provide materials derived from a group of novel and unique viruses causing hepatitis, such as, polynucleotides, recombinant and synthetic polypeptides encoded therein, antibodies which specifically bind to these polypeptides, and diagnostics and vaccines that employ these materials. Such materials could greatly enhance the ability of the medical community to more accurately diagnose acute and/or chronic viral hepatitis and could provide a safer blood and organ supply by detecting non-A, non-B and non-C hepatitis in these blood and organ donations.

SUMMARY OF THE INVENTION

The present invention provides a purified polynucleotide or fragment thereof derived from hepatitis GB virus (HGBV) capable of selectively hybridizing to the genome of HGBV or the complement thereof, wherein said polynucleotide is characterized by a positive stranded RNA genome wherein said genome comprises an open reading frame (ORF) encoding a polyprotein wherein said polyprotein comprises an amino acid sequence having at least 35% identity, more preferably, 40% identity, even more preferably, 60% identity, and yet more preferably, 80% identity to an amino acid sequence selected from the group consisting of HGBV-A, HGBV-B and HGBV-C. Also provided is a recombinant polynucleotide or fragment therof derived from hepatitis GB virus (HGBV) capable of selectively hybridizing to the genome of HGBV or the complement thereof, wherein said nucleotide comprises a sequence that encodes at least one epitope of HGBV, and wherein said recombinant nucleotide is characterized by a positive stranded RNA genome wherein said genome comprises an open reading frame (ORF) encoding a polyprotein wherein said polyprotein comprises an amino acid sequence having at least 35% identity to an amino acid sequence selected from the group consisting of HGBV-A, HGBV-B and HGBV-C. Such a recombinant plynucleotide is contained within a recombinant vector and further comprises a host cell transformed with said vector.

The present invention also probides a hepatitis GB virus (HGBV) recombinant polynucleotide or fragment thereof comprising a nucleotide sequence derived from an HGBV genome, wherein said polynucleotide is contained within a recombinant vector and further comprises a host cell transformed with said vector. and further wherein said sequence encodes an epitope of HGBV. The HGBV recombinant polynucleotide is characterized by a positive stranded RNA genome wherein said genome comprises an open reading frame (ORF) encoding a polyprotein wherein said polyprotein comprises an amino acid sequence having at least 35% identity to an amino acid sequence selected from the group consisting of HGBV-A, HGBV-B and HGBV-C. The present invention provides a recombinant expression system comprising an open reading frame of DNA or RNA derived from hepatitis GB virus (HGBV) wherein said open reading frame comprises a sequence of HGBV genome or cDNA and wherein said open reading frame is operably linked to a control sequence compatible with a desired host, and further comprises a cell transformed with said recombinant expression system and a polypeptide of at least about eight amino acids in length produced by said cell.

The present invention additionally provides a purified hepatitis GB virus (HGBV) comprising a preparation of HGBV polypeptide or fragment thereof, a recombinant polypeptide comprising an amino acid sequence or fragment thereof wherein said sequence is characterized by a positive stranded RNA genome wherein said genome comprises an open reading frame (ORF) encoding a polyprotein wherein said polyprotein comprises an amino acid sequence having at least 35% identity, more preferably 40% identity and yet more preferably 60% identity to an amino acid sequence selected from the group consisting of HGBV-A, HGBV-B and HGBV-C. Antibodies, both polyclonal and monoclonal, are provided by the present invention, as well as, a fusion polypeptide comprising at least one hepatitis GB virus (HGBV) polypeptide or fragment thereof, a particle that is immunogenic against hepatitis GB virus (HGBV) infection, comprising a non-HGBV polypeptide having an amino acid sequence capable of forming a particle when said sequence is produced in a eukaryotic or prokaryotic host, and at least one HGBV epitope, and a polynucleotide probe for hepatitis GB virus (HGBV) wherein said polynucleotide probe is characterized by a positive stranded RNA genome wherein said genome comprises an open reading frame (ORF) encoding a polyprotein wherein said polyprotein comprises an amino acid sequence having at least 35% identity to an amino acid sequence selected from the group consisting of HGBV-A, HGBV-B and HGBV-C.

Assay kits also are provided, as well as methods for producing a polypeptide containing at least one hepatitis GB virus (HGBV) epitope comprising incubating host cells transformed with an expression vector comprising a sequence encoding a polypeptide characterized by a positive stranded RNA genome wherein said genome comprises an open reading frame (ORF) encoding a polyprotein wherein said polyprotein comprises an amino acid sequence having at least 35% identity to an amino acid sequence selected from the group consisting of HGBV-A, HGBV-B and HGBV-C. Also provided are methods of detecting HGBV nucelic acids, antigens and antibodies in test samples, including methods which utilize solid phases, recombinant or synthetic peptides, or probes. Vaccines also are provided by the present invention, as are tissue culture grown cell infected with hepatitis GB virus (HGBV), a method for producing antibodies to hepatitis GB virus (HGBV) comprising administering to an individual an isolated immunogenic polypeptide or fragment thereof comprising at least one HGBV epitope in an amount sufficient to produce an immune response. Diagnostic reagents also are provided herein which comprises polynucleotides or polypeptides or fragments thereof.

BRIEF DESCRIPTION OF THE DRAWINGS

FIGS. 1–12 are graphs of individual tamarins which plot the amount of liver enzyme (ALT or ICD) as measured in mU/ml against time (weeks post inoculation), where ALT CO indicates the cuttoff value for ALT, and ICD CO indicates the cutoff value of ICD, wherein FIG. 1 shows the graph of tamarin T-1053;

FIG. 2 shows the graph of tamarin T-1048;

FIG. 3 shows the graph of tamarin T-1057;

FIG. 4 shows the graph of tamarin T-1061;

FIG. 5 shows the graph of tamarin T-1047;

FIG. 6 shows the graph of tamarin T-1042;

FIG. 7 shows the graph of tamarin T-1044;

FIG. 8 shows the graph of tamarin T-1034;

FIG. 9 shows the graph of tamarin T-1055;

FIG. 10 shows the graph of tamarin T-1051;

FIG. 11 shows the graph of tamarin T-1038; and

FIG. 12 shows the graph of tamarin T-1049.

FIGS. 23A–C show dot plot analyses of the nucleic acid sequences wherein:

FIG. 23A shows a dot blot comparison of HGBV-A;

FIG. 23B shows a dot blot comparison of HGBV-B;

FIG. 23C shows a dot blot comparison of HGBV-A v, HGBV-B.

FIGS. 24A–B show the conserved residues as follows:

FIG. 24A shows the conserved residues in the putative NTP-binding helicase domain of predicted translation products of HGBV-A, HGBV-B and HCV-1 NS3, FIG. 24B shows the conserved residues of the RNA-dependent RNA polymerase domain of predicted translation products of HGBV-A, HGBV-B and HCV-1 NS5b.

FIGS. 25A–B show Coomassie-stained 10% SDS-polyacrylamide gels of CKS fusion protein whole cell lysates; three CKS fusion proteins demonstrate immunoreactivity with HGBV-infected tamarin sera.

FIGS. 26 to 30 are graphs of individual tamarins which plot 1) the amount of liver enzyme (ALT) as measured in mU/ml against time (weeks post inoculation) as shown by a solid line; 2) ELISA absorbance values for the CKS-1.7 recombinant protein as shown by filled circles connected by dotted lines; 3) ELISA absorbance values for the CKS-1.4 recombinant protein as shown by open circles connected by dotted lines; 4) ELISA absorbance values for the CKS-4.1 recombinant protein as shown by crosses connected by dotted lines; 5) negative PCR results using SEQ ID #21 primers as shown by empty squares; 6) postivive PCR results using SEQ ID #21 primers as shown by filled squares; 7) negative PCR results using SEQ ID #26 primers as shown by empty diamonds; 8) positive PCR results using SEQ ID #26 primers as shown by filled diamonds; 9) inoculation dates are indicated by the arrowheads, wherein FIGS. 26A–C show the graph of tamarin T-1048;

FIG. 27 shows the graph of tamarin T-1057;

FIG. 28 shows the graph of tamarin T-1061;

FIG. 29 shows the graph of tamarin T-1051; and

FIG. 30 shows the graph of tamarin T-1034.

FIGS. 31–34 are graphs of a human test specimens which plots 1) the amount of liver enzyme (ALT) as measured in mU/ml against time (weeks post inoculation) as shown by a solid line; 2) ELISA absorbance values for the CKS-1.7 recombinant protein as shown by dotted lines, filled circles; 3) ELISA absorbance values for the CKS-1.4 recombinant protein as shown by dotted lines, open circles, wherein FIG. 31 shows a graph of patient 101;

FIG. 32 shows a graph of patient 257;

FIG. 33 shows a graph of patient 260; and

FIG. 34 shows a graph of patient 340.

FIGS. 35A–B show conserved residues, wherein

FIG. 35A shows the conserved residues in the putative NTP-binding helicase domain of predicted translation products of Contig. A, Contig. B and HCV-1 NS3, and FIG. 35B shows the conserved residues of the RNA-dependent RNA polymerase domain of predicted translation products of Contig. A, Contig. B and HCV-1 NS5b.

FIG. 36 shows a nucleotide alignment of HGBV-A, HGBV-B, HGBV-C and HCV-1.

FIG. 38 shows a nucleotide alignment of HGBV-C with two variant clones.

FIG. 40 shows a nucleotide alignment of HGBV-C with four variant clones.

DETAILED DESCRIPTION OF THE INVENTION

Figure 1:
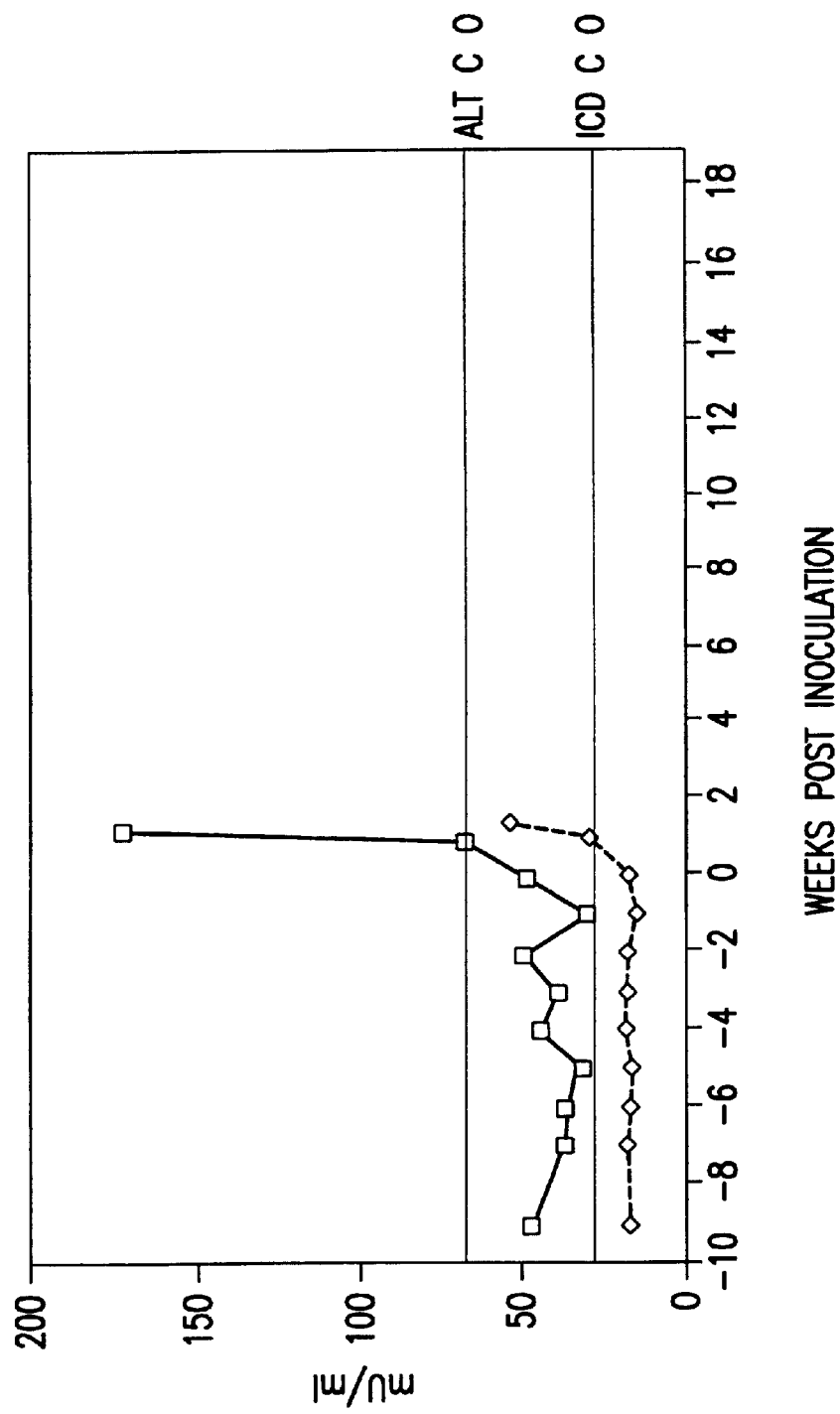

The present invention provides characterization of a newly ascertained etiological agents of non-A, non-B, non-C, non-D and non-E hepatitis-causing agents, collectively so-termed "Hepatitis GB Virus," or "HGBV." The present invention provides a method for determining the presence of the HGBV etiological agents, methods for obtaining the nucleic acid of this etiological agents created from infected serum, plasma or liver homogenates from individuals, either humans or tamarins, with HGBV to detect newly synthesized antigens derived from the genome of heretofore unisolated viral agents, and of selecting clones which produced products which are only found in infectious individuals as compared to non-infected individuals.

Portions of the nucleic acid sequences derived from HGBV are useful as probes to determine the presence of HGBV in test samples, and to isolate naturally occurring variants. These sequences also make available polypeptide sequences of HGBV antigens encoded within the HGBV genome(s) and permit the production of polypeptides which are useful as standards or reagents in diagnostic tests and/or as components of vaccines. Monoclonal and polyclonal antibodies directed against at least one epitope contained within these polypeptide sequences also are useful for diagnostic tests as well as therapeutic agents, for screening of antiviral agents, and for the isolation of the HGBV agent from which these nucleic acid sequences are derived. Isolation and sequencing of other portions of the HGBV genome also can be accomplished by utilizing probes or PCR primers derived from these nucleic acid sequences, thus allowing additional probes and polypeptides of the HGBV to be established, which will be useful in the diagnosis and/or treatment of HGBV, both as a prophylactic and therapeutic agent.

According to one aspect of the invention, there will be provided a purified HGBV polynucleotide, a recombinant HGBV polynucleotide, a recombinant polynucleotide comprising a sequence derived from an HGBV genome; a recombinant polypeptide encoding an epitope of HGBV; a synthetic peptide encoding an epitope of HGBV; a recombinant vector containing any of the above described recombinant polypeptides, and a host cell transformed with any of these vectors. These recombinant polypeptides and synthetic peptides may be used alone or in combination, or in conjunction with other substances representing epitopes of HGBV.

In another aspect of the invention there will be provided purified HGBV; a preparation of polypeptides from the purified HGBV; a purified HGBV polypeptide; a purified polypeptide comprising an epitope which is immunologically identical with an epitope contained in HGBV.

In yet another aspect of the invention there will be provided a recombinant expression system comprising an open reading frame (ORF) of DNA derived from an HGBV genome or from HGBV cDNA, wherein the ORF is operably linked to a control sequence compatible with a desired host, a cell transformed with the recombinant expression system, and a polypeptide produced by the transformed cell.

Additional aspects of the present invention include at least one recombinant HGBV polypeptide, at least one recombinant polypeptide comprised of a sequence derived from an HGBV genome or from HGBV cDNA; at least one recombinant polypeptide comprised of an HGBV epitope and at least one fusion polypeptide comprised of an HGBV polypeptide.

The present invention also provides methods for producing a monoclonal antibody which specifically binds to at least one epitope of HGBV; a purified preparation of polyclonal antibodies which specifically bind to at least one HGBV epitope; and methods for using these antibodies, which include diagnostic, prognostic and therapeutic uses.

In still another aspect of the invention there will be provided a particle which immunizes against HGBV infection comprising a non-HGBV polypeptide having an amino acid sequence capable of forming a particle when said sequence is produced in an eukaryotic host, and an HGBV epitope.

A polynucleotide probe for HGBV also will be provided.

The present invention provides kits containing reagents which can be used for the detection of the presence and/or amount of polynucleotides derived from HGBV, such reagents comprising a polynucleotide probe containing a nucleotide sequence from HGBV of about 8 or more nucleotides in a suitable container; a reagent for detecting the presence and/or amount of an HGBV antigen comprising an antibody directed against the HGBV antigen to be detected in a suitable container; a reagent for detecting the presence and/or amount of antibodies directed against an HGBV antigen comprising a polypeptide containing an HGBV epitope present in the HGBV antigen, provided in a suitable container. Other kits for various assay formats also are provided by the present invention as described herein.

Other aspects of the present invention include a polypeptide comprising at least one HGBV epitope attached to a solid phase and an antibody to an HGBV epitope attached to a solid phase. Also included are methods for producing a polypeptide containing an HGBV epitope comprising incubating host cells transformed with an expression vector containing a sequence encoding a polypeptide containing an HGBV epitope under conditions which allow expression of the polypeptide, and a polypeptide containing an HGBV epitope produced by this method.

The present invention also provides assays which utilize the recombinant or synthetic polypeptides provided by the invention, as well as the antibodies described herein in various formats, any of which may employ a signal generating compound in the assay. Assays which do not utilize signal generating compounds to provide a means of detection also are provided. All of the assays described generally detect either antigen or antibody, or both, and include contacting a test sample with at least one reagent provided herein to form at least one antigen/antibody complex and detecting the presence of the complex. These assays are described in detail herein.

Vaccines for treatment of HGBV infection comprising an immunogenic peptide containing an HGBV epitope, or an inactivated preparation of HGBV, or an attenuated preparation of HGBV, or the use of recombinant vaccines that express HGBV epitope(s) and/or the use of synthetic peptides, also are included in the present invention. An effective vaccine may make use of combinations of these immunogenic peptides (such as, a cocktail of recombinant antigens, synthetic peptides and native viral antigens administered simultaneously or at different times); some of these may be utilized alone and be supplemented with other representations of immunogenic epitopes at later times. Also included in the present invention is a method for producing antibodies to HGBV comprising administering to an individual an isolated immunogenic polypeptide containing an HGBV epitope in an amount sufficient to produce an immune response in the inoculated individual.

Also provided by the present invention is a tissue culture grown cell infected with HGBV.

In yet another aspect of the present invention is provided a method for isolating DNA or cDNA derived from the genome of an unidentified infectious agent, which is a unique modification of representational difference analysis (RDA), and which is described in detail hereinbelow.

Definitions

The term "Hepatitis GB Virus" or "HGBV", as used herein, collectively denotes a viral species which causes non-A, non-B, non-C, non-D, non-E hepatitis in man, and attenuated strains or defective interfering particles derived therefrom. This may include acute viral hepatitis transmitted by contaminated foodstuffs, drinking water, and the like; hepatitis due to HGBV transmitted via person to person contact (including sexual transmission, respiratory and parenteral routes) or via intraveneous drug use. The methods as described herein will allow the identification of individuals who have acquired HGBV. Individually, the HGBV isolates are specifically referred to as "HGBV-A", "HGBV-B" and "HGBV-C." As described herein, the HGBV genome is comprised of RNA. Analysis of the nucleotide sequence and deduced amino acid sequence of the HGBV reveals that viruses of this group have a genome organization similar to that of the Flaviridae family. Based primarily, but not exclusively, upon similarities in genome organization, the International Committee on the Taxonomy of Viruses has recommended that this family be composed of three genera: Flavivirus, Pestivirus, and the hepatitis C group. Similarity searches at the amino acid level reveal that the hepatitis GB virus subclones have some, albeit low, sequence resemblence to hepatitis C virus. The information provided herein is sufficient to allow classification of other strains of HGBV.

Several lines of evidence demonstrate that HGBV-C is not a genotype of HCV. First, sera containing HGB-C sequences were tested for the presence of HCV antibody. Routine detection of individuals exposed to or infected with HCV relies upon antibody tests which utilize antigens derived from three or more regions from HCV-1. These tests allow detection of antibodies to the known genotypes of HCV (See, for example, Sakamoto et al., *J. Gen. Virol.* 75:1761–1768 (1994) and Stuyver et al., *J. Gen. Virol.* 74:1093–1102 (1993). HCV-specific ELISAs failed to detect sera containing GB-C sequences in six of eight cases (TABLE A). Second, several human sera that were seronegative for HCV antibodies have been shown to be positive for HCV genomic RNA by a highly sensitive RT-PCR assay (Sugitani, *Lancet* 339:1018–1019 (1992). This assay failed to detect HCV RNA in seven of eight sera containing HGB-C sequences (TABLE A). Thus, HGBV-C is not a genotype of HCV based on both serologic and molecular assays.

The alignment of a portion of the predicted translation product of HGB-C within the helicase region with the homologous region of HGBV-A, HGBV-B, HCV-1 and additional members of the Flaviviridae, followed by phylogenetic analysis of the aligned sequences suggests that HGBV-C is more closely related to HGBV-A than to any member of the HCV group. The sequences of HGBV-C and HGBV-A, while exhibiting an evolutionary distance of 0.42, are not as divergent as HGBV-C is from HGBV-B, which shows an evolutionary distance of 0.92 (TABLE 33, infra.). Thus, HGBV-A and HGBV-C may be considered to be members of one subgroup of the GB viruses and GBV-B a member of its own subgroup. The phylogenetic analysis of the helicase sequences from various HCV isolates show that they form a much less diverged group, exhibiting a maximum evolutionary distance of 0.20 (TABLE 32, infra.). A comparison of the HCV group and the HGBV group shows a minimum evolutionary distance between any two sequences from each group of 0.69. The distance values reported hereinabove were used to generate a phylogenic tree presented in FIG. 42. The relatively high degree of divergence among these viruses suggests that the GB viruses are not merely types or subtypes within the hepatitis C group; rather, they constitute their own phyletic group (or groups). Phylogenetic analysis using sequence information derived from a small portion of HCV viral genomes has been shown to be an acceptable method for the assignment of new isolates into genotypic groups (Simmonds et al., *Hepatology* 19:1321–1324 (1994). In the current analysis, the use of a 110 amino acid sequence within the helicase gene from representative HCV isolates has properly grouped them into their respective genotypes (Simmonds et al., *J. Gen. Virol.* 75:1053–1061 (1994). Therefore, the evolutionary distances shown, in all liklihood, accurately refect the high degree of divergence between the GB viruses and the hepatitis C virus.

In previous applications, it was stated that "HGBV strains are identifiable on the polypeptide level and that HGBV strains are more than 40% homologous, preferably more than about 60% homologous, and even more preferably more than about 80% homologous at the polypeptide level." As it is used, the term "homologous," when referring to the degree of relatedness of two polynucleotide or polypeptide sequences, can be ambiguous and actually implies an evolutionary relationship. As is now the current convention in the art, the term "homologous" is no longer used; instead the terms "similarity" and/or "identity" are used to describe the degree of relatedness between two polynucleotides or polypeptide sequences. The techniques for determining amino acid sequence "similarity" and/or "identity" are well-known in the art and include, for example, directly determining the amino acid sequence and comparing it to the seqeunces provided herein; determining the nucleotide sequence of the genomic material of the putative HGBV (usually via a cDNA intermediate), and determining the amino acid sequence encoded therein, and comparing the corresponding regions. In general, by "identity" is meant the exact match-up of either the nucleotide sequence of HGBV and that of another strain(s) or the amino acid sequence of HGBV and that of another strain(s) at the appropriate place on each genome. Also, in general, by "similarity" is meant the exact match-up of amino acid sequence of HGBV and that of another strain(s) at the appropriate place, where the amino acids are identical or possess similar chemical and/or physical porperties such as charge or hydrophobicity. The programs available in the Wisconsin Sequence Analysis Package, Version 8 (available from the Genetics Computer Group, Madison, Wis., 53711), for example, the GAP program, are capable of calculating both the identity and similarity between two polynucleotide or two polypeptide sequences. Other programs for calculating identity and similarity between two sequences are known in the art.

Additionally, the following parameters are applicable, either alone or in combination, in identifying a strain of HGBV-A, HGBV-B or HGBV-C. It is expected that the overall nucleotide sequence identity of the genomes between HGBV-A, HGBV-B or HGBV-C and a strain of one of these hepatitis GB viruses will be about 45% or greater, since it is now believed that the HGBV strains may be genetically related, preferably about 60% or greater, and more preferably, about 80% or greater.

Also, it is expected thjat the overall sequence identity of the genomes between HGBV-A and a strain of HGBV-A at the amino acid level will be about 35% or greater since it is now believed that the HGBV strains may be genetically related, preferably about 40% or greater, more preferably, about 60% or greater, and even more preferably, about 80% or greater. In addition, there will be corresponding contiguous sequences of at least about 13 nucleotides, which may be provided in combination of more than one contiguous sequence. Also, it is expected that the overall sequence identity of the genomes between HGBV-B and a strain of HGBV-B at the amino acid level will be about 35% or greater since it is now believed that the HGBV strains may be genetically related, preferably about 40% or greater, more preferably, about 60% or greater, and even more preferably, about 80% or greater. In addition, there will be corresponding contiguous sequences of at least about 13 nucleotides, which may be provided in combination of more than one contiguous sequence. Also, it is expected that the overall sequence identity of the genomes between HGBV-C and a strain of HGBV-C at the amino acid level will be about 35% or greater since it is now believed that the HGBV strains may be genetically related, preferably about 40% or greater, more preferably, about 60% or greater, and even more preferably, about 80% or greater. In addition, there will be corresponding contiguous sequences of at least about 13 nucleotides, which may be provided in combination of more than one contiguous sequence.

The compositions and methods described herein will enable the propagation, identification, detection and isolation of HGBV and its possible strains. Moreover, they also will allow the preparation of diagnostics and vaccines for the possible different strains of HGBV, and will have utility in screening procedures for anti-viral agents. The information will be sufficient to allow a viral taxonomist to identify other strains which fall within the species. We believe that HGBV encodes the sequences that are included herein. Methods for assaying for the presence of these sequences are known in the art and include, for example, amplification methods such as ligase chain reaction (LCR), polymerase chain reaction (PCR) and hybridization. In addition, these sequences contain open reading frames from which an immunogenic viral epitope may be found. This epitope is unique to HGBV when compared to other known hepatitis-causing viruses. The uniqueness of the epitope may be determined by its immunological reactivity with HGBV and lack of immunological reactivity with Hepatitis A, B, C, D and E viruses. Methods for determining immunological reactivity are known in the art and include, for example, radioimmunoassay (RIA), enzyme-linked immunosorbant assay (ELISA), hemagglutination (HA), fluorescence polarization immunoassay (FPIA) and several examples of suitable techniques are described herein.

A polynucleotide "derived from" a designated sequence for example, the HGBV cDNA, or from the HGBV genome, refers to a polynucleotide sequence which is comprised of a sequence of approximately at least about 6 nucleotides, is preferably at least about 8 nucleotides, is more preferably at least about 10–12 nucleotides, and even more preferably is at least about 15–20 nucleotides corresponding, i.e., similar to or complementary to, a region of the designated nucleotide sequence. Preferably, the sequence of the region from which the polynucleotide is derived is similar to or complementary to a sequence which is unique to the HGBV genome. Whether or not a sequence is complementary to or similar to a sequence which is unique to an HGBV genome can be determined by techniques known to those skilled in the art. Comparisons to sequences in databanks, for example, can be used as a method to determine the uniqueness of a designated sequence. Regions from which sequences may be derived include but are not limited to regions encoding specific epitopes, as well as non-translated and/or non-transcribed regions.

The derived polynucleotide will not necessarily be derived physically from the nucleotide sequence of HGBV, but may be generated in any manner, including but not limited to chemical synthesis, replication or reverse transcription or transcription, which are based on the information provided by the sequence of bases in the region(s) from which the polynucleotide is derived. In addition, combinations of regions corresponding to that of the designated sequence may be modified in ways known in the art to be consistent with an intended use.

A "polypeptide" or "amino acid sequence derived from a designated nucleic acid sequence or from the HGBV genome refers to a polypeptide having an amino acid sequence identical to that of a polypeptide encoded in the sequence or a portion thereof wherein the portion consists of at least 3 to 5 amino acids, and more preferably at least 8 to 10 amino acids, and even more preferably 15 to 20 amino acids, or which is immunologically identifiable with a polypeptide encoded in the sequence.

A "recombinant polypeptide" as used herein means at least a polypeptide of genomic, semisynthetic or synthetic origin which by virtue of its origin or manipulation is not associated with all or a portion of the polypeptide with which it is associated in nature or in the form of a library and/or is linked to a polynucleotide other than that to which it is linked in nature. A recombinant or derived Polypeptide is not necessarily translated from a designated nucleic acid sequence of HGBV or from an HGBV genome. It also may be generated in any manner, including chemical synthesis or expression of a recombinant expression system, or isolation from mutated HGBV.

The term "synthetic peptide" as used herein means a polymeric form of amino acids of any length, which may be chemically synthesized by methods well-known to the routineer. These synthetic peptides are useful in various applications.

The term "polynucleotide" as used herein means a polymeric form of nucleotides of any length, either ribonucleotides or deoxyribonucleotides. This term refers only to the primary structure of the molecule. Thus, the term includes double- and single-stranded DNA, as well as double- and single-stranded RNA. It also includes modifications, either by methylation and/or by capping, and unmodified forms of the polynucleotide.

"HGBV containing a sequence corresponding to a cDNA" means that the HGBV contains a polynucleotide sequence which is similar to or complementary to a sequence in the designated DNA. The degree of similarity or complementarity to the cDNA will be approximately 50% or greater, will preferably be at least about 70%, and even more preferably will be at least about 90%. The sequence which corresponds will be at least about 70 nucleotides, preferably at least about 80 nucleotides, and even more preferably at least about 90 nucleotides in length. The correspondence between the HGBV and the cDNA can be determined by methods known in the art, and include, for example, a direct comparison of the sequenced material with the cDNAs described, or hybridization and digestion with single strand nucleases, followed by size determination of the digested fragments.

"Purified viral polynucleotide" refers to an HGBV genome or fragment thereof which is essentially free, i.e., contains less than about 50%, preferably less than about 70%, and even more preferably, less than about 90% of polypeptides with which the viral polynucleotide is naturally associated. Techniques for purifying viral polynucleotides are well known in the art and include, for example, disruption of the particle with a chaotropic agent, and separation of the polynucleotide(s) and polypeptides by ion-exchange chromatography, affinity chromatography, and sedimentation according to density. Thus, "purified viral polypeptide" means an HGBV polypeptide or fragment thereof which is essentially free, that is, contains less than about 50%, preferably less than about 70%, and even more preferably, less than about 90% of of cellular components with which the viral polypeptide is naturally associated. Methods for purifying are known to the routineer.

"Polypeptide" as used herein indicates a molecular chain of amino acids and does not refer to a specific length of the product. Thus, peptides, oligopeptides, and proteins are included within the definition of polypeptide. This term, however, is not intended to refer to post-expression modifications of the polypeptide, for example, glycosylations, acetylations, phosphorylations and the like.

"Recombinant host cells," "host cells," "cells," "cell lines," "cell cultures," and other such terms denoting microorganisms or higher eucaryotic cell lines cultured as unicellular entities refer to cells which can be, or have been, used as recipients for recombinant vector or other transfer DNA, and include the original progeny of the original cell which has been transfected.

As used herein "replicon" means any genetic element, such as a plasmid, a chromosome or a virus, that behaves as an autonomous unit of polynucleotide replication within a cell. That is, it is capable of replication under its own control.

A "vector" is a replicon in which another polynucleotide segment is attached, such as to bring about the replication and/or expression of the attached segment.

The term "control sequence refers to polynucleotide sequences which are necessary to effect the expression of coding sequences to which they are ligated. The nature of such control sequences differs depending upon the host organism. In prokaryotes, such control sequences generally include promoter, ribosomal binding site and terminators; in eukaryotes, such control sequences generally include promoters, terminators and, in some instances, enhancers. The term "control sequence thus is intended to include at a minimum all components whose presence is necessary for expression, and also may include additional components whose presence is advantageous, for example, leader sequences.

"Operably linked" refers to a situation wherein the components described are in a relationship permitting them to function in their intended manner. Thus, for example, a control sequence "operably linked" to a coding sequence is ligated in such a manner that expression of the coding sequence is achieved under conditions compatible with the control sequences.

The term "open reading frame" or "ORF" refers to a region of a polynucleotide sequencewhich encodes a polypeptide; this region may represent a portion of a coding sequence or a total coding sequence.

A "coding sequence" is a polynucleotide sequencewhich is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to, mRNA, cDNA, and recombinant polynucleotide sequences.

The term "immunologically identifiable with/as" refers to the presence of epitope(s) and polypeptide(s) which also are present in and are unique to the designated polypeptide(s), usually HGBV proteins. Immunological identity may be determined by antibody binding and/or competition in binding. These techniques are known to the routineer and also are described herein. The uniqueness of an epitope also can be determined by computer searches of known data banks, such as GenBank, for the polynucleotide sequences which encode the epitope, and by amino acid sequence comparisons with other known proteins.

As used herein, "epitope" means an antigenic determinant of a polypeptide. Conceivably, an epitope can comprise three amino acids in a spatial conformation which is unique to the epitope. Generally, an epitope consists of at least five such amino acids, and more usually, it consists of at least eight to ten amino acids. Methods of examining spatial conformation are known in the art and include, for example, x-ray crystallography and two-dimensional nuclear magnetic resonance.

A polypeptide is "immunologically reactive" with an antibody when it binds to an antibody due to antibody recognition of a specific epitope contained within the polypeptide. Immunological reactivity may be determined by antibody binding, more particularly by the kinetics of antibody binding, and/or by competition in binding using as competitor(s) a known polypeptide(s) containing an epitope against which the antibody is directed. The methods for determining whether a polypeptide is immunologically reactive with an antibody are known in the art.

As used herein, the term "immunogenic polypeptide containing an HGBV epitope" means naturally occurring HGBV polypeptides or fragments thereof, as well as polypeptides prepared by other means, for example, chemical synthesis or the expression of the polypeptide in a recombinant organism.

The term "transformation" refers to the insertion of an exogenous polynucleotide into a host cell, irrespective of the method used for the insertion. For example, direct uptake, transduction, or f-mating are included. The exogenous polynucleotide may be maintained as a non-integrated vector, for example, a plasmid, or alternatively, may be integrated into the host genome.

"Treatment" refers to prophylaxis and/or therapy.

The term "individual" as used herein refers to vertebrates, particularly members of the mammalian species and includes but is not limited to domestic animals, sports animals, primates and humans; more particularly the term refers to tamarins and humans.

The term "plus strand" (or "+") as used herein denotes a nucleic acid that contains the sequencethat encodes the polypeptide. The term "minus strand" (or "−") denotes a nucleic acid that contains a sequence that is complementary to that of the "plus" strand.

"Positive stranded genome" of a virus denotes that the genome, whether RNA or DNA, is single-stranded and which encodes a viral polypeptide(s).

The term "test sample" refers to a component of an individual's body which is the source of the analyte (such as, antibodies of interest or antigens of interest). These components are well known in the art. These test samples include biological samples which can be tested by the methods of the present invention described herein and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens; and fixed cell specimens.

"Purified HGBV" refers to a preparation of HGBV which has been isolated from the cellular constituents with which the virus is normally associated, and from other types of viruses which may be present in the infected tissue. The techniques for isolating viruses are known to those skilled in the art and include, for example, centrifugation and affinity chromatography.

"PNA" denotes a "peptide nucleic analog" which may be utilized in a procedure such as an assay to determine the presence of a target. PNAs are neutrally charged moieties which can be directed against RNA targets or DNA. PNA probes used in assays in place of, for example, DNA probes, offer advantages not acheivable when DNA probes are used. These advantages include manufacturability, large scale labeling, reproducibility, stability, insensitivity to changes in ionic strength and resistance to enzymatic degradation which is present in methods utilizing DNA or RNA. These PNAs can be labeled with such signal generating compounds as flouorescein, radionucleotides, chemiluminescent compounds, and the like. PNAs thus can be used in methods in place of DNA or RNA. Although assays are described herein utilizing DNA, it is within the scope of the routineer that PNAs can be substituted for RNA or DNA with appropriate changes if and as needed in assay reagents.

General Uses

After preparing recombinant proteins, synthetic peptides, or purified viral polypeptides of choice as described by the present invention, the recombinant or synthetic peptides can be used to develop unique assays as described herein to detect either the presence of antigen or antibody to HGBV. These compositions also can be used to develop monoclonal and/or polyclonal antibodies with a specific recombinant protein or synthetic peptide which specifically bind to the immunological epitope of HGBV which is desired by the routineer. Also, it is contemplated that at least one polynucleotide of the invention can be used to develop vaccines by following methods known in the art.

It is contemplated that the reagent employed for the assay can be provided in the form of a test kit with one or more containers such as vials or bottles, with each container containing a separate reagent such as a monoclonal antibody, or a cocktail of monoclonal antibodies, or a polypeptide (either recombinant or synthetic) employed in the assay. Other components such as buffers, controls, and the like, known to those of ordinary skill in art, may be included in such test kits.

"Solid phases" ("solid supports") are known to those in the art and include the walls of wells of a reaction tray, test tubes, polystyrene beads, magnetic beads, nitrocellulose strips, membranes, microparticles such as latex particles, sheep (or other animal) red blood cells, duracytes and others. The "solid phase" is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing peptides on solid phases include ionic, hydrophobic, covalent interactions and the like. A "solid phase", as used herein, refers to any material which is insoluble, or can be made insoluble by a subsequent reaction. The solid phase can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid phase and which has the ability to immobilize the capture reagent through a specific binding reaction. The receptor molecule enables the indirect binding of the capture reagent to a solid phase material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes and other configurations known to those of ordinary skill in the art.

It is contemplated and within the scope of the invention that the solid phase also can comprise any suitable porous material with sufficient porosity to allow access by detection antibodies and a suitable surface affinity to bind antigens. Microporous structures are generally preferred, but materials with gel structure in the hydrated state may be used as well. Such useful solid supports include: natural polymeric carbohydrates and their synthetically modified, cross-linked or substituted derivatives, such as agar, agarose, cross-linked alginic acid, substituted and cross-linked guar gums, cellulose esters, especially with nitric acid and carboxylic acids, mixed cellulose esters, and cellulose ethers; natural polymers containing nitrogen, such as proteins and derivatives, including cross-linked or modified gelatins; natural hydrocarbon polymers, such as latex and rubber; synthetic polymers which may be prepared with suitably porous structures, such as vinyl polymers, including polyethylene, polypropylene, polystyrene, polyvinylchloride, polyvinylacetate and its partially hydrolyzed derivatives, polyacrylamides, polymethacrylates, copolymers and terpolymers of the above polycondensates, such as polyesters, polyamides, and other polymers, such as polyurethanes or polyepoxides; porous inorganic materials such as sulfates or carbonates of alkaline earth metals and magnesium, including barium sulfate, calcium sulfate, calcium carbonate, silicates of alkali and alkaline earth metals, aluminum and magnesium; and aluminum or silicon oxides or hydrates, such as clays, alumina, talc, kaolin, zeolite, silica gel, or glass (these materials may be used as filters with the above polymeric materials); and mixtures or copolymers of the above classes, such as graft copolymers obtained by initializing polymerization of synthetic polymers on a pre-existing natural polymer. All of these materials may be used in suitable shapes, such as films, sheets, or plates, or they may be coated onto or bonded or laminated to appropriate inert carriers, such as paper, glass, plastic films, or fabrics.

The porous structure of nitrocellulose has excellent absorption and adsorption qualities for a wide variety of reagents including monoclonal antibodies. Nylon also possesses similar characteristics and also is suitable. It is contemplated that such porous solid supports described hereinabove are preferably in the form of sheets of thickness from about 0.01 to 0.5 mm, preferably about 0.1 mm. The pore size may vary within wide limits, and is preferably from about 0.025 to 15 microns, especially from about 0.15 to 15 microns. The surfaces of such supports may be activated by chemical processes which cause covalent linkage of the antigen or antibody to the support. The irreversible binding of the antigen or antibody is obtained, however, in general, by adsorption on the porous material by poorly understood hydrophobic forces. Suitable solid supports also are described in U.S. patent application Ser. No. 227,272.

The "indicator reagent" comprises a "signal generating compound" (label) which is capable of generating and generates a measurable signal detectable by external means conjugated (attached) to a specific binding member for HGBV. "Specific binding member" as used herein means a member of a specific binding pair. That is, two different molecules where one of the molecules through chemical or physical means specifically binds to the second molecule. In addition to being an antibody member of a specific binding pair for HGBV, the indicator reagent also can be a member of any specific binding pair, including either hapten-antihapten systems such as biotin or anti-biotin, avidin or biotin, a carbohydrate or a lectin, a complementary nucleotide sequence, an effector or a receptor molecule, an enzyme cofactor and an enzyme, an enzyme inhibitor or an enzyme, and the like. An immunoreactive specific binding member can be an antibody, an antigen, or an antibody/antigen complex that is capable of binding either to HGBV as in a sandwich assay, to the capture reagent as in a competitive assay, or to the ancillary specific binding member as in an indirect assay.

The various "signal generating compounds" (labels) contemplated include chromogens, catalysts such as enzymes, luminescent compounds such as fluorescein and rhodamine, chemiluminescent compounds such as dioxetanes, acridiniums, phenanthridiniums and luminol, radioactive elements, and direct visual labels. Examples of enzymes include alkaline phosphatase, horseradish peroxidase, beta-galactosidase, and the like. The selection of a particular label is not critical, but it will be capable of producing a signal either by itself or in conjunction with one or more additional substances.

The present invention provides assays which utilize specific binding members. A "specific binding member," as used herein, is a member of a specific binding pair. That is, two different molecules where one of the molecules through chemical or physical means specifically binds to the second molecule. Therefore, in addition to antigen and antibody specific binding pairs of common immunoassays, other specific binding pairs can include biotin and avidin, carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog. Immunoreactive specific binding members include antigens, antigen fragments, antibodies and antibody fragments, both monoclonal and polyclonal, and complexes thereof, including those formed by recombinant DNA molecules. The term "hapten", as used herein, refers to a partial antigen or non-protein binding member which is capable of binding to an antibody, but which is not capable of eliciting antibody formation unless coupled to a carrier protein.

"Analyte," as used herein, is the substance to be detected which may be present in the test sample. The analyte can be any substance for which there exists a naturally occurring specific binding member (such as, an antibody), or for which a specific binding member can be prepared. Thus, an analyte is a substance that can bind to one or more specific binding members in an assay. "Analyte" also includes any antigenic substances, haptens, antibodies, and combinations thereof. As a member of a specific binding pair, the analyte can be detected by means of naturally occurring specific binding partners (pairs) such as the use of intrinsic factor protein as a member of a specific binding pair for the determination of Vitamin B12, the use of folate-binding protein to determine folic acid, or the use of a lectin as a member of a specific binding pair for the determination of a carbohydrate. The analyte can include a protein, a peptide, an amino acid, a nucleotide target, and the like.

Other embodiments which utilize various other solid phases also are contemplated and are within the scope of this invention. For example, ion capture procedures for immobilizing an immobilizable reaction complex with a negatively charged polymer, described in co-pending U. S. patent application Ser. No. 150,278 corresponding to EP publication 0326100 and U. S. patent application Ser. No. 375,029 (EP publication no. 0406473), can be employed according to the present invention to effect a fast solution-phase immunochemical reaction. An immobilizable immune complex is separated from the rest of the reaction mixture by ionic interactions between the negatively charged poly-anion/immune complex and the previously treated, positively charged porous matrix and detected by using various signal generating systems previously described, including those described in chemiluminescent signal measurements as described in co-pending U.S. patent application Ser. No. 921,979 corresponding to EPO Publication No. 0 273,115.

Also, the methods of the present invention can be adapted for use in systems which utilize microparticle technology including in automated and semi-automated systems wherein the solid phase comprises a microparticle (magnetic or non-magnetic). Such systems include those described in pending U. S. patent applications Ser. Nos. 425,651 and 425,643, which correspond to published EPO applications Nos. EP 0 425 633 and EP 0 424 634, respectively.

The use of scanning probe microscopy (SPM) for immunoassays also is a technology to which the monoclonal antibodies of the present invention are easily adaptable. In scanning probe microscopy, in particular in atomic force microscopy, the capture phase, for example, at least one of the monoclonal antibodies of the invention, is adhered to a solid phase and a scanning probe microscope is utilized to detect antigen/antibody complexes which may be present on the surface of the solid phase. The use of scanning tunnelling microscopy eliminates the need for labels which normally must be utilized in many immunoassay systems to detect antigen/antibody complexes. Such a system is described in pending U. S. patent application Ser. No. 662,147. The use of SPM to monitor specific binding reactions can occur in many ways. In one embodiment, one member of a specific binding partner (analyte specific substance which is the monoclonal antibody of the invention) is attached to a surface suitable for scanning. The attachment of the analyte specific substance may be by adsorption to a test piece which comprises a solid phase of a plastic or metal surface, following methods known to those of ordinary skill in the art. Or, covalent attachment of a specific binding partner (analyte specific substance) to a test piece which test piece comprises a solid phase of derivatized plastic, metal, silicon, or glass may be utilized. Covalent attachment methods are known to those skilled in the art and include a variety of means to irreversibly link specific binding partners to the test piece. If the test piece is silicon or glass, the surface must be activated prior to attaching the specific binding partner. Activated silane compounds such as triethoxy amino propyl silane (available from Sigma Chemical Co., St. Louis, Mo.), triethoxy vinyl silane (Aldrich Chemical Co., Milwaukee, Wis.), and (3-mercapto-propyl)-trimethoxy silane (Sigma Chemical Co., St. Louis, Mo.) can be used to introduce reactive groups such as amino-, vinyl, and thiol, respectively. Such activated surfaces can be used to link the binding partner directly (in the cases of amino or thiol) or the activated surface can be further reacted with linkers such as glutaraldehyde, bis (succinimidyl) suberate, SPPD 9 succinimidyl 3-[2-pyridyldithio] propionate), SMCC (succinimidyl-4-[N-maleimidomethyl] cyclohexane-1-carboxylate), SIAB (succinimidyl [4-iodoacetyl] aminobenzoate), and SMPB (succinimidyl 4-[1-maleimidophenyl]butyrate) to separate the binding partner from the surface. The vinyl group can be oxidized to provide a means for covalent attachment. It also can be used as an anchor for the polymerization of various polymers such as poly acrylic acid, which can provide multiple attachment points for specific binding partners. The amino surface can be reacted with oxidized dextrans of various molecular weights to provide hydrophilic linkers of different size and capacity. Examples of oxidizable dextrans include Dextran T-40 (molecular weight 40,000 daltons), Dextran T-110 (molecular weight 110,000 daltons), Dextran T-500 (molecular weight 500,000 daltons), Dextran T-2M (molecular weight 2,000,000 daltons) (all of which are available from Pharmacia), or Ficoll (molecular weight 70,000 daltons (available from Sigma Chemical Co., St. Louis, Mo.). Also, polyelectrolyte interactions may be used to immobilize a specific binding partner on a surface of a test piece by using techniques and chemistries described by pending U. S. patent applications Ser. No. 150,278, filed Jan. 29, 1988, and Ser. No. 375,029, filed Jul. 7, 1989. The preferred method of attachment is by covalent means. Following attachment of a specific binding member, the surface may be further treated with materials such as serum, proteins, or other blocking agents to minimize non-specific binding. The surface also may be scanned either at the site of manufacture or point of use to verify its suitability for assay purposes. The scanning process is not anticipated to alter the specific binding properties of the test piece.

Various other assay formats may be used, including "sandwich" immunoassays and probe assays. For example, the monoclonal antibodies of the present invention can be employed in various assay systems to determine the presence, if any, of HGBV proteins in a test sample. Fragments of these monoclonal antibodies provided also may be used. For example, in a first assay format, a polyclonal or monoclonal anti-HGBV antibody or fragment thereof, or a combination of these antibodies, which has been coated on a solid phase, is contacted with a test sample which may contain HGBV proteins, to form a mixture. This mixture is incubated for a time and under conditions sufficient to form antigen/antibody complexes. Then, an indicator reagent comprising a monoclonal or a polyclonal antibody or a fragment thereof, which specifically binds to an HGBV region, or a combination of these antibodies, to which a signal generating compound has been attached, is contacted with the antigen/antibody complexes to form a second mixture. This second mixture then is incubated for a time and under conditions sufficient to form antibody/antigen/antibody complexes. The presence of HGBV antigen present in the test sample and captured on the solid phase, if any, is determined by detecting the measurable signal generated by the signal generating compound. The amount of HGBV antigen present in the test sample is proportional to the signal generated.

Alternatively, a polyclonal or monoclonal anti-HGBV antibody or fragment thereof, or a combination of these antibodies which is bound to a solid support, the test sample and an indicator reagent comprising a monoclonal or polyclonal antibody or fragments thereof, which specifically binds to HGBV antigen, or a combination of these antibodies to which a signal generating compound is attached, are contacted to form a mixture. This mixture is incubated for a time and under conditions sufficient to form antibody/antigen/antibody complexes. The presence, if any, of HGBV proteins present in the test sample and captured on the solid phase is determined by detecting the measurable signal generated by the signal generating compound. The amount of HGBV proteins present in the test sample is proportional to the signal generated.

In another alternate assay format, one or a combination of at least two monoclonal antibodies of the invention can be employed as a competitive probe for the detection of antibodies to HGBV protein. For example, HGBV proteins, either alone or in combination, can be coated on a solid phase. A test sample suspected of containing antibody to HGBV antigen then is incubated with an indicator reagent comprising a signal generating compound and at least one monoclonal antibody of the invention for a time and under conditions sufficient to form antigen/antibody complexes of either the test sample and indicator reagent to the solid phase or the indicator reagent to the solid phase. The reduction in binding of the monoclonal antibody to the solid phase can be quantitatively measured. A measurable reduction in the signal compared to the signal generated from a confirmed negative NANB, non-C, non-D, non-E hepatitis test sample indicates the presence of anti-HGBV antibody in the test sample.

In yet another detection method, each of the monoclonal or polyclonal antibodies of the present invention can be employed in the detection of HGBV antigens in fixed tissue sections, as well as fixed cells by immunohistochemical analysis. Cytochemical analysis wherein these antibodies are labelled directly (fluorescein, colloidal gold, horseradish peroxidase, alkaline phosphatase, etc.) or are labelled by using secondary labelled anti-species antibodies (with various labels as exemplified herein) to track the histopathology of disease also are within the scope of the present invention.

In addition, these monoclonal antibodies can be bound to matrices similar to CNBr-activated Sepharose and used for the affinity purification of specific HGBV proteins from cell cultures, or biological tissues such as blood and liver such as to purify recombinant and native viral HGBV antigens and proteins.

The monoclonal antibodies of the invention can also be used for the generation of chimeric antibodies for therapeutic use, or other similar applications.

The monoclonal antibodies or fragments thereof can be provided individually to detect HGBV antigens. Combinations of the monoclonal antibodies (and fragments thereof) provided herein also may be used together as components in a mixture or "cocktail" of at least one anti-HGBV antibody of the invention with antibodies to other HGBV regions, each having different binding specificities. Thus, this cocktail can include the monoclonal antibodies of the invention which are directed to HGBV proteins and other monoclonal antibodies to other antigenic determinants of the HGBV genome.

The polyclonal antibody or fragment thereof which can be used in the assay formats should specifically bind to a specific HGBV region or other HGBV proteins used in the assay. The polyclonal antibody used preferably is of mammalian origin; human, goat, rabbit or sheep anti-HGBV polyclonal antibody can be used. Most preferably, the polyclonal antibody is rabbit polyclonal anti-HGBV antibody. The polyclonal antibodies used in the assays can be used either alone or as a cocktail of polyclonal antibodies. Since the cocktails used in the assay formats are comprised of either monoclonal antibodies or polyclonal antibodies having different HGBV specificity, they would be useful for diagnosis, evaluation and prognosis of HGBV infection, as well as for studying HGBV protein differentiation and specificity.

It is contemplated and within the scope of the present invention that the HGBV group of viruses may be detectable in assays by use of a synthetic, recombinant or native peptide that is common to all HGBV viruses. It also is within the scope of the present invention that different synthetic, recombinant or native peptides isentifying different epitopes from HGBV-A, HGBV-B, HGBV-C, or yet other HGBV viruses, can be used in assay formats. In the later case, these can be coated onto one solid phase, or each separate peptide may be coated on separate solid phases, such as microparticles, and then combined to form a mixture of peptides which can be later used in assays. Such variations of assay formats are known to those of ordinary skill in the art and are discussed hereinbelow.

In another assay format, the presence of antibody and/or antigen to HGBV can be detected in a simultaneous assay, as follows. A test sample is simultaneously contacted with a capture reagent of a first analyte, wherein said capture reagent comprises a first binding member specific for a first analyte attached to a solid phase and a capture reagent for a second analyte, wherein said capture reagent comprises a first binding member for a second analyte attached to a second solid phase, to thereby form a mixture. This mixture is incubated for a time and under conditions sufficient to form capture reagent/first analyte and capture reagent/second analyte complexes. These so-formed complexes then are contacted with an indicator reagent comprising a member of a binding pair specific for the first analyte labelled with a signal generating compound and an indicator reagent comprising a member of a binding pair specific for the second analyte labelled with a signal generating compound to form a second mixture. This second mixture is incubated for a time and under conditions sufficient to form capture reagent/first analyte/indicator reagent complexes and capture reagent/second analyte/indicator reagent complexes. The presence of one or more analytes is determined by detecting a signal generated in connection with the complexes formed on either or both solid phases as an indication of the presence of one or more analytes in the test sample. In this assay format, proteins derived from human expression systems may be utilized as well as monoclonal antibodies produced from the proteins derived from the mammalian expression systems as disclosed herein. Such assay systems are described in greater detail in pending U.S. patent application Ser. No. 07/574,821 entitled Simultaneous Assay for Detecting One Or More Analytes, which corresponds to EP Publication No. 0473065.

In yet other assay formats, recombinant proteins and/or synthetic peptides may be utilized to detect the presence of anti-HGBV in test samples. For example, a test sample is incubated with a solid phase to which at least one recombinant protein or synthetic peptide has been attached. These are reacted for a time and under conditions sufficient to form antigen/antibody complexes. Following incubation, the antigen/antibody complex is detected. Indicator reagents may be used to facilitate detection, depending upon the assay system chosen. In another assay format, a test sample is contacted with a solid phase to which a recombinant protein or synthetic peptide produced as described herein is attached and also is contacted with a monoclonal or polyclonal antibody specific for the protein, which preferably has been labelled with an indicator reagent. After incubation for a time and under conditions sufficient for antibody/antigen complexes to form, the solid phase is separated from the free phase, and the label is detected in either the solid or free phase as an indication of the presence of HGBV antibody. Other assay formats utilizing the proteins of the present invention are contemplated. These include contacting a test sample with a solid phase to which at least one antigen from a first source has been attached, incubating the solid phase and test sample for a time and under conditions sufficient to form antigen/antibody complexes, and then contacting the solid phase with a labelled antigen, which antigen is derived from a second source different from the first source. For example, a recombinant protein derived from a first source such as *E. coli* is used as a capture antigen on a solid phase, a test sample is added to the so-prepared solid phase, and a recombinant protein derived from a different source (i.e., non-*E. coli*) is utilized as a part of an indicator reagent. Likewise, combinations of a recombinant antigen on a solid phase and synthetic peptide in the indicator phase also are possible. Any assay format which utilizes an antigen specific for HGBV from a first source as the capture antigen and an antigen specific for HGBV from a different second source are contemplated. Thus, various combinations of recombinant antigens, as well as the use of synthetic peptides, purified viral proteins, and the like, are within the scope of this invention. Assays such as this and others are described in U.S. Pat. No. 5,254,458, which enjoys common ownership and is incorporated herein by reference.

Other assay systems which utilize an antibody (polyclonal, monoclonal or naturally-occurring) which specifically binds HGBV viral particles or sub-viral particles housing the viral genome (or fragments thereof) by virtue of a contact between the specific antibody and the viral protein (peptide, etc.). This captured particle then can be analyzed by methods such as LCR or PCR to determine whether the viral genome is present in the test sample. Test samples which can be assayed according to this method include blood, liver, sputum, urine, fecal material, saliva, and the like. The advantage of utilizing such an antigen capture amplification method is that it can separate the viral genome from other molecules in the test specimen by use of a specific antibody. Such a method has been described in pending U.S. patent application Ser. No. 08/141,429.

While the present invention discloses the preference for the use of solid phases, it is contemplated that the reagents such as antibodies, proteins and peptides of the present invention can be utilized in non-solid phase assay systems. These assay systems are known to those skilled in the art, and are considered to be within the scope of the present invention.

Materials and Methods

General Techniques

Conventional and well-known techniques and methods in the fields of molecular biology, microbiology, recombinant DNA and immunology are employed in the practice of the invention unless otherwise noted. Such techniques are explained and detailed in the literature. See, for example, J. Sambrook et al., *Molecular Cloning: A Laboratory Manual,* 2nd edition, Cold Spring Harbor Press, Cold Spring Harbor, N.Y. (1989); D. N. Glover, ed., *DNA Cloning, Volumes I and II* (1985); M. J. Gait ed., *Oligonucleotide Synthesis,* (1984); B. D. Hames et al., eds., *Nucleic Acid Hybridization,* (1984); B. D. Hames et al., eds., *Transcription and Translation,* (1984); R. I. Freshney ed., *Animal Cell Culture,* (1986); *Immobilized Cells and Enzymes,* IRL Press (1986); B. Perbal, *A Practical Guide to Molecular Cloning,* (1984); the series, *Methods in Enzymology,* Academic Press, Inc., Orlando, Fla.; J. H. Miller et al., eds., *Gene Transfer Vectors For Mammalian Cells,* Cold Spring Harbor Laboratory, Cold Spring Harbor, N.Y. (1987); Wu et al., eds., Methods in Enzymology, Vol. 154 and 155 ; Mayer et al., eds., *Immunological Methods In Cell and Molecular Biology,* Academic Press, London (1987); Scopes, *Protein Purification: Principles and Practice,* 2nd ed., Springer-Verlag, N.Y.; and D. Weir et al., eds., *Handbook Of Experimental Immunology,* Volumes I–IV (1986); N. Lisitisyn et al., *Science* 259:946–951 (1993).

The reagents and methods of the present invention are made possible by the provision of a family of closely related nucleotide sequences, isolated by representational difference analysis modified as described herein, present in the plasma, serum or liver homogenate of an HGBV infected individual, either tamarin or human. This family of nucleotide sequences is not of human or tamarin origin, since it will be shown that it hybridizes to neither human nor tamarin genomic DNA from uninfected individuals, since nucleotides of this family of sequences are present only in liver (or liver homogenates), plasma or serum of individuals infected with HGBV, and since the sequence is not present in GenBank. In addition, the family of sequences will show no significant identity at the nucleic acid level to sequences contained within the HAV, HBV, HCV, HDV and HEV genome, and low level identity, considered not significant, as translation products. Infectious sera, plasma or liver homogenates from HGBV infected humans contain these polynucleotide sequences, whereas sera, plasma or liver homogenates from non-infected humans do not contain these sequences. Northern blot analysis of infected liver with some of these polynucleotide sequences demonstrate that they are derived from a large RNA transcript similar in size to a viral genome. Sera, plasma or liver homogenates from HGBV-infected humans contain antibodies which bind to this polypeptide, whereas sera, plasma or liver homogenates from non-infected humans do not contain antibodies to this polypeptide; these antibodies are induced in individuals following acute non-A, non-B, non-C, non-D and non-E infection. By these criteria, it is believed that the sequence is a viral sequence, wherein the virus causes or is associated with non-A, non-B, non-C, non-D and non-E hepatitis.

The availability of this family of nucleic acid sequences permits the construction of DNA probes and polypeptides useful in diagnosing non-A, non-B, non-C, non-D, non-E hepatitis due to HGBV infections, and in screening blood donors, donated blood, blood products and individuals for infection. For example, from the sequence it is possible to synthesize DNA oligomers of about eight to ten nucleotides, or larger, which are useful as hybridization probes or PCR primers to detect the presence of the viral genome in, for example, sera of subjects suspected of harboring the virus, or for screening donated blood for the presence of the virus. The family of nucleic acid sequences also allows the design and production of HGBV specific polypeptides which are useful as diagnostic reagents for the presence of antibodies raised during infection with HGBV. Antibodies to purified polypeptides derived from the nucleic acid sequences may also be used to detect viral antigens in infected individuals and in blood. These nucleic acid sequences also enable the design and production of polypeptides which may be used as vaccines against HGBV, and also for the production of antibodies, which then may be used for protection of the disease, and/or for therapy of HGBV infected individuals.

The family of nucleic acid sequences also enables further characterization of the HGBV genome. Polynucleotide probes derived from these sequences may be used to screen genomic or cDNA libraries for additional overlapping nucleic acid sequences which then may be used to obtain more overlapping sequences. Unless the genome is segmented and the segments lack common sequences, this technique may be used to gain the sequence of the entire genome. However, if the genome is segmented, other segments of the genome can be obtained by either repeating the RDA cloning procedure as described and modified hereinbelow or by repeating the lambda-gt11 serological screening procedure discussed hereinbelow to isolate the clones which will be described herein, or alternatively by isolating the genome from purified HGBV particles.

The family of cDNA sequences and the polypeptides derived from these sequences, as well as antibodies directed against these polypeptides, also are useful in the isolation and identification of the HGBV etiological agent(s). For example, antibodies directed against HGBV epitopes contained in polypeptides derived from the nucleic acid sequences may be used in methods based upon affinity chromatography to isolate the virus. Alternatively, the antibodies can be used to identify viral particles isolated by other techniques. The viral antigens and the genomic material within the isolated viral particles then may be further characterized.

The information obtained from further sequencing of the HGBV genome(s), as well as from further characterization of the HGBV antigens and characterization of the genome enables the design and synthesis of additional probes and polypeptides and antibodies which may be used for diagnosis, prevention and therapy of HGBV induced non-A, non-B, non-C non-D, non-E hepatitis, and for screening of infected blood and blood-related products.

The availability of probes for HGBV, including antigens, antibodies and polynucleotides derived from the genome from which the family of nucleic acid sequences is derived also allows for the development of tissue culture systems which will be of major use in elucidating the biology of HGBV. Once this is known, it is contemplated that new treatment regimens may be developed based upon antiviral compounds which preferentially inhibit the replication of or infection by HGBV.

Figure 13:
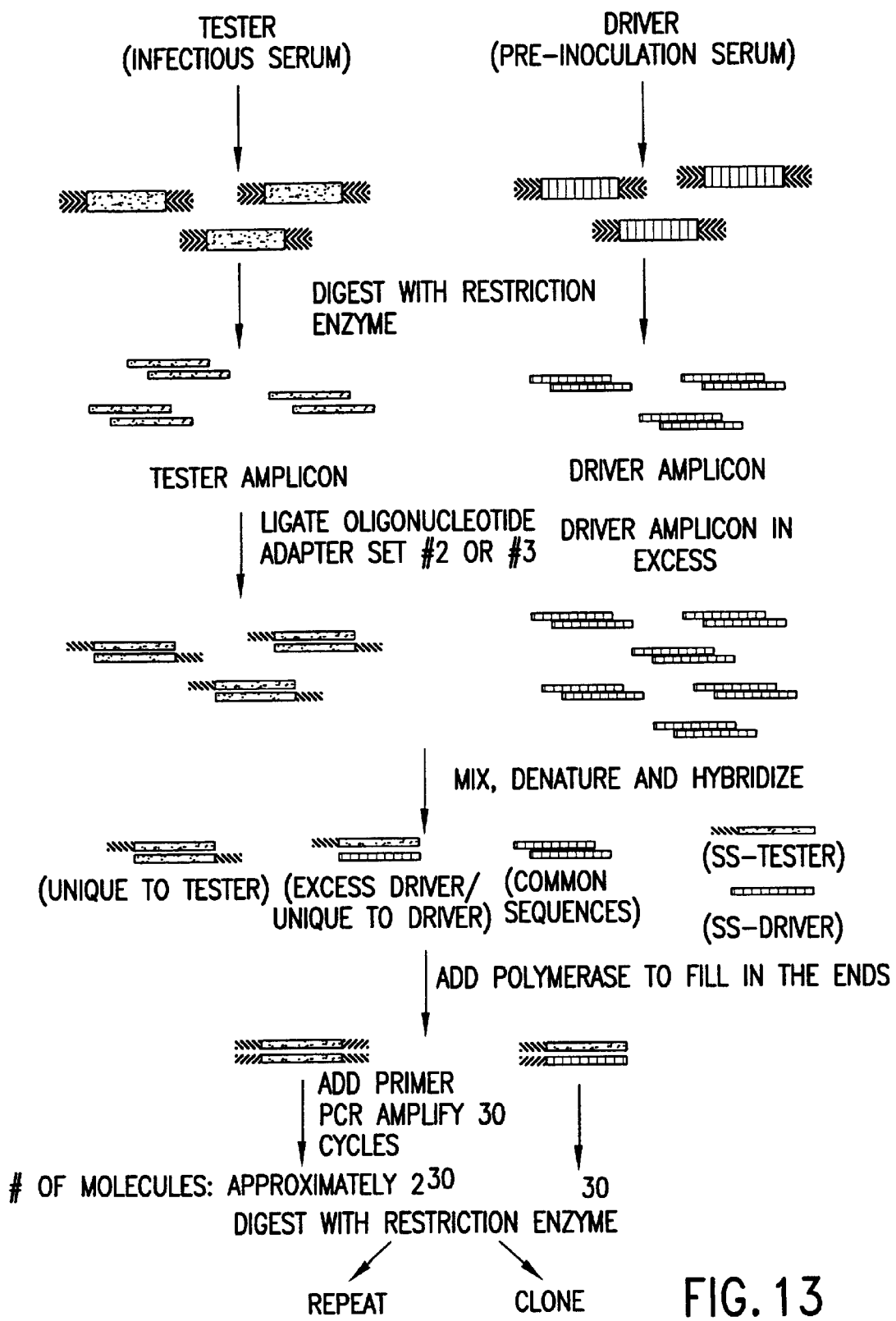
FIG. 13 presents a flow diagram of the steps involved in representational difference analysis (RDA), the procedure used for identifying clones.

In one method used to identify and isolate the etiological agent of HGBV, the cloning/isolation of the GB agent was achieved by modifying the published procedure known as representational difference analysis (RDA), as reported by N. Lisitsyn et al., *Science* 259: 946–951 (1993). This method is based upon the principles of subtractive hybridization for cloning DNA differences between two complex mammalian genomes. Briefly, in this procedure, the two genomes under evaluation are identified generically as the "tester" (containing the target sequence of interest) and the "driver" (representing normal DNA). Lisitsyn et al.'s description of RDA is limited to identifying and cloning DNA differences between complex, but similar DNA backgrounds. These differences may include any large DNA viruses (eg. $\geq 25,000$ base pairs of DNA) that is present in a cell line, blood, plasma or tissue sample and absent in an uninfected cell line, blood, plasma or tissue sample. Because previous literature suggested that HGBV may be a small virus containing either a DNA or RNA genome of $\leq 10,000$ bases, the RDA protocol was modified such as to allow the detection of small viruses. The major steps of the procedure are described hereinbelow and are diagramed in FIG. 13.

Briefly, in step 1, total nucleic acid (DNA and RNA) is isolated using commercially available kits. RDA requires that the sample be highly matched. Ideally, tester and driver nucleic acid samples should be obtained from the same source (animal, human or other). It may be possible to use highly related, but non-identical, material for the source of the tester and driver nucleic acids. Double stranded DNA is generated from the total nucleic acid by random primed reverse transcription of the RNA followed by random primed DNA synthesis. This treatment converts single strand RNA viruses and single strand DNA viruses to double strand DNA molecules which are ammenable to RDA. If one chooses to assume that an unknown virus has a DNA or an RNA genome, a DNA-only or RNA-only extraction procedure can be employed and double-stranded DNA can be generated as described in the art.

In step 2, the tester and driver nucleic acids are amplified to generate an abundant amount of material which represents the total nucleic acid extracted from the pre-inoculation and infectious plasma sources (ie. the tester amplicon and the driver amplicon). This is achieved by cleaving double-stranded DNA prepared as described above with a restriction endonuclease which has a 4 bp recognition site (such as Sau3A I). The DNA fragments are ligated to oligonucleotide adaptors (set #1). The DNA fragments are end-filled and PCR amplified. Following PCR amplification, the oligonucleotide adaptor (set #1) is then removed by restriction endonuclease digestion (for example, with Sau3A I), liberating a large amount of tester and driver nucleic acid to be used in subsequent subtractive hybridization techniques.

In step 3, the experimental design is to enrich for DNA unique to the tester genome. This is achieved by combining subtractive hybridization and kinetic enrichment into a single step. Briefly, an oligonucleotide adaptor set (#2 or #3) is ligated to the 5' ends of the tester amplicon. The tester amplicon and an excess of driver amplicon are mixed, denatured and allowed to hybridized for 20 hours. A large amount of the sequences that are held in common between the tester and driver DNA will anneal during this time. In addition, sequences that are unique to the tester amplicon will reanneal. However, because of the limited time of hybridization, some single-standed tester and driver DNA will remain.

In step 4, the 3' ends of the reannealed tester and driver DNA are filled in using a thermostable DNA polymerase at elevated temperature as described in the art. The reannealed sequences that are unique to the tester contain the ligated adaptor on both strands of the annealed sequence. Thus, 3' end-filling of these molecules creates sequences complementary to PCR primers on both DNA strands. As such, these DNA species will be amplified exponentially when subjected to PCR. In contrast, the relatively large amount of hybrid molecules containing sequences held in common between tester and driver amplicons (ie. one strand was derived from the tester amplicon and one strand was derived from the driver amplicon) will be amplified linearly when subjected to PCR. This is because only one strand (derived from the tester amplicon) contains the ligated adaptor sequence, and 3' end filling will only generate sequences complementary to the PCR primer on the strand derived from the driver amplicon.

In step 5, the double-strand DNA of interest is enriched quantitatively using PCR for 10 cycles of amplification. As stated above in step 4, reannealed tester sequences will be amplified exponentially whereas sequences held in common between tester and driver amplicons will be amplified linearly.

In step 6, single-strand DNA which remains is removed by a single strand DNA nuclease digestion using mung bean nuclease as described in the art.

In step 7, double-stranded DNA which remains after nuclease digestion is PCR amplified an additional 15 to 25 cycles.

Finally in step 8, these DNA products are cleaved with restriction endonuclease to remove the oligonucleotide adaptors. These DNA products can then be subjected to subsequent rounds of amplification (beginning at step #3 using the oligonucleotide adaptor set that was not used in the previous cycle of RDA) or cloned into a suitable plasmid vector for further analysis.

The RDA procedure as described supra is a modification of the representational difference analysis known in the art. The method was modified to isolate viral clones from pre-inoculation and infectious sera sources. These modifications are discussed further below and relate to the preparation of amplicons for both tester and driver DNA. First, the starting material was not double-stranded DNA obtained from the genomic DNA of mammalian cells as reported previously, but total nucleic acid extracted from infectious and pre-inoculation biological blood samples obtained from tamarins. It is possible that other biological samples (for example, organs, tissue, bile, feces or urine) could be used as sources of nucleic acid from which tester and driver amplicons are generated. Second, the amount of starting nucleic acid is substantially less than that described in the art. Third, a restriction endonuclease with a 4 bp instead of a 6 bp recognition site was used. This is substantially different from the prior art. Lisitsyn et al. teach that RDA works because the generation of amplicons (ie. representations) decreases the complexity of the DNA that is being hybridized (ie. subtracted).

In the prior art, restriction enzymes that have 6 bp recognition sites were used to fragment the genome. These restriction endonucleases cleave approximately every 4000 bp. However, the PCR conditions described in the prior art amplify sequences $\leq 1500$ bp in size. Therefore, subsequent PCR amplification of a complex species of DNA (such as a genome) that has been fragmented with a restriction enzyme that recognizes a 6 bp sequence results in the generation of amplicons that contain the fraction of the DNA that was $\leq 1500$ bp in size after restriction endonuclease digestion. This reduction in DNA complexity (estimated to be a 10- to 50-fold reduction) is reported to be necessary for the hybridization step of RDA to work. If the complexity is not reduced, unique sequences in the tester will not be able to efficiently hybridize during the subtraction step, and therefore, these unique sequences will not be amplified exponentially during the subsequent PCR steps of RDA.

The reduction of complexity of the nucleic acid sequences being subjected to RDA undermines using RDA effectively to isolate relatively small viruses. The odds of two 6 bp-recognition sites occurring within 1.5 kb of each other is sufficiently rare that one might miss a small ($\leq 10$ kb) virus (TABLE 1).

TABLE 1

| Virus | Enzyme | # of Fragments <1.5 kb |
| --- | --- | --- |
| λ | BamH I | 0 |
| (~50 kb) | Bgl II | 3 |
|  | Hind III | 1 |
| Parvo B19 | BamH I | 0 |
| (~5 kb) | Bgl II | 0 |
|  | Hind III | 2 |
|  | Sau3A I (4 bp site) | 5–7 |
| HBV | BamH I | 1–2 |
| (~3.2 kb) | Bgl II | 1–2 |
|  | HindIII | 0 |
|  | Sau3A I (4 bp site) | 12 |

However, we have discovered that RDA may be useful in cloning small viruses if a more frequently cutting restriction endonuclease is used to fragment the DNA being subjected to RDA. As shown in TABLE 1, amplicons based on 4 bp recognition site enzymes will almost certainly contain several fragments from any small virus, as restriction endonucleases which have 4 bp recognition sites fragment DNA approximately every 250 base pairs. However, it is likely that amplicons will be as complex as the source of the nucleic acid from which they were generated because nearly all of the DNA species will be ≦1500 bp after digestion with a 4 bp recognizing restriction endonuclease and thus, subject to PCR amplification. Since the relative viral sequence copy number is predicted to be higher than any specific or endogenous sequence copy number, the unique viral sequences that are present in the tester amplicon should be able to form double stranded molecules during the hybridization step (step 3, above). Therefore, these sequences will be amplified exponentially as described above. It is reasoned that as the relative viral sequence copy number becomes closer to that of the background or endogenous nucleic acid sequence copy number, a restriction endonuclease which recognizes a redundant 6 bp sequence (for example BstYI or HincII) and cleaves approximately every 1000 bp, or the simultaneous use of several restriction endonuclease which recognizes 6 bp sequences, may be used to fragment the DNA prior to amplification by PCR. In this way, one can moderately reduce the complexity of the amplicons being subjected to RDA while minimizing the risk of excluding viral sequeces from the tester amplicon. The utility of this procedure is demonstrated by the cloning of HGBV sequences from infectious tamarin plasma described herein.

Immunoscreening to Identify HGBV Immunoreactive Epitopes

Immunoscreening as described herein as follows also provided an additional means of identifying HGBV sequences. Pooled or individual serum, plasma or liver homogenates from an individual meeting the criteria and within the parameters set forth below with acute or chronic HGBV infection is used to isolate viral particles. Nucleic acids isolated from these particles are used as the template in the construction of a genomic and/or cDNA library to the viral genome. The procedures used for isolation of putative HGBV particles and for constructing the genomic and/or cDNA library in lambda-gt11 or similar systems known in the art is discussed hereinbelow. Lambda-gt11 is a vector that has been developed specifically to express inserted cDNAs as fusion polypeptides with betagalactosidase and to screen large numbers of recombinant phage with specific antisera raised against a defined antigen. The lambda-gt11 cDNA library generated from a cDNA pool containing cDNA is screened for encoded epitopes that can bind specifically with sera derived from individuals who previously had experienced non-A, non-B, non-C, non-D and non-E hepatitis. See V. Hunyh et al., in D. Glover, ed, *DNA Cloning Techniques; A Practical Approach*, IRL Press, Oxford, England, pp. 49–78 (1985). Approximately $10^6$–$10^7$ phage are screened, from which positive phage are identified, purified, and then tested for specificity of binding to sera from different individuals previously infected with the HGBV agent. Phage which selectively bind sera or plasma from patients meeting the criteria described hereinbelow and not in patients who did not meet these described criteria, are preferred for further study. By utilizing the technique of isolating overlapping nucleic acid sequences, clones containing additional upstream and downstream HGBV sequences are obtained. Analysis of the nucleotide sequences of the HGBV nucleic acid sequences encoded within the isolated clones is performed to determine whether the composite sequence contains one long continuous ORF.

The sequences (and their complements) retrieved from the HGBV sequence as provided herein, and the sequences or any portion thereof, can be prepared using synthetic methods or by a combination of synthetic methods with retrieval of partial sequences using methods similar to those described herein. This description thus provides one method by which genomic or cDNA sequences corresponding to the entire HGBV genome may be isolated. Other methods for isolating these sequences, however, will be obvious to those skilled in the art and are considered to be within the scope of the present invention.

Deposit of Strains

Strains replicated (clones 2, 4, 10, 16, 18, 23 and 50) from the HGBV nucleic acid sequence library have been deposited at the American Type Culture Collection, 12301 Parklawn Drive, Rockville, Md. 20852, as of Feb. 10, 1994, under the terms of the Budapest Treaty and will be maintained for a period of thirty (30) years from the date of deposit, or for five (5) years after the last request for the deposit, or for the enforceable period of the U.S. patent, whichever is longer. The deposits and any other deposited material described herein are provided for convenience only, and are not required to practice the present invention in view of the teachings provided herein. The HGBV cDNA sequences in all of the deposited materials are incorporated herein by reference. The plasmids were accorded the following A.T.C.C. deposit numbers: Clone 2 was accorded A.T.C.C. Deposit No. 69556; Clone 4 was accorded A.T.C.C. Deposit No. 69557; Clone 10 was accorded A.T.C.C. Deposit No. 69558; Clone 16 was accorded A.T.C.C. Deposit No. 69559; Clone 18 was accorded A.T.C.C. Deposit No. 69560; Clone 23 was accorded A.T.C.C. Deposit No. 69561; and Clone 50 was accorded A.T.C.C. Deposit No. 69562.

Strains replicated (clones 11, 13, 48 and 119) from the HGBV nucleic acid sequence library have been deposited at the American Type Culture Collection, 12301 Parklawn Drive, Rockville, Md. 20852, as of Apr. 29, 1994, under the terms of the Budapest Treaty and will be maintained for a period of thirty (30) years from the date of deposit, or for five (5) years after the last request for the deposit, or for the enforceable period of the U.S. patent, whichever is longer. The deposits and any other deposited material described herein are provided for convenience only, and are not required to practice the present invention in view of the teachings provided herein. The HGBV cDNA sequences in all of the deposited materials are incorporated herein by reference. The plasmids were accorded the following A.T.C.C. deposit numbers: Clone 11 was accorded A.T.C.C. Deposit No. No. 69613; Clone 13 was accorded A.T.C.C. Deposit No. 69611; Clone 48 was accorded A.T.C.C. Deposit No. 69610; and Clone 119 was accorded A.T.C.C. Deposit No. 69612.

Additional strains (clones 4-B 1.1, 66-3A1.49, 70-3A1.37 and 78-1C1.17) from the HGBV nucleic acid sequence library have been deposited at the American Type Culture Collection, 12301 Parklawn Drive, Rockville, Md. 20852, as of Jul. 28, 1994, under the terms of the Budapest Treaty and will be maintained for a period of thirty (30) years from the date of deposit, or for five (5) years after the last request for the deposit, or for the enforceable period of the U.S. patent, whichever is longer. The deposits and any other deposited material described herein are provided for convenience only, and are not required to practice the present invention in view of the teachings provided herein. The HGBV cDNA sequences in all of the deposited materials are incorporated herein by reference. The plasmids were accorded the following A.T.C.C. deposit numbers: Clone 4-B1.1 was accorded A.T.C.C. Deposit No. No. 69666; Clone 66-3A1.49 was accorded A.T.C.C. Deposit No. 69665; Clone 70-3A1.37 was accorded A.T.C.C. Deposit No. 69664; and Clone 78-1C1.17 was accorded A.T.C.C. Deposit No. 69663.

Clone pHGBV-C clone #1 was deposited at the American Type Culture Collection, 12301 Parklawn Drive, Rockville, Md. 20852 as of Nov. 8, 1994, under the terms of the Budapest Treaty and will be maintained for a period of thirty (30) years from the date of deposit, or for five (5) years after the last request for the deposit, or for the enforceable period of the U.S. patent, whichever is longer. The deposits and any other deposited material described herein are provided for convenience only, and are not required to practice the present invention in view of the teachings provided herein. pHGBV-C clone #1 was accorded A.T.C.C. Deposit No. 69711. The HGBV cDNA sequences in all of the deposited materials are incorporated herein by reference.

Preparation of Viral Polypeptides and Fragments

The availability of nucleic acid sequences permits the construction of expression vectors encoding antigenically active regions of the polypeptide encoded in either strand. These antigenically active regions may be derived from structural regions of the virus, including, for example, envelope (coat) or core antigens, in addition to nonstructural regions of the virus, including, for example, polynucleotide binding proteins, polynucleotide polymerase(s), and other viral proteins necessary for replication and/or assembly of the viral particle. Fragments encoding the desired polypeptides are derived from the genomic or cDNA clones using conventional restriction digestion or by synthetic methods, and are ligated into vectors which may, for example, contain portions of fusion sequences such as beta-galactosidase (β-gal) or superoxide dismutase (SOD) or CMP-KDO synthetase (CKS). Methods and vectors which are useful for the production of polypeptides which contain fusion sequences of SOD are described in EPO 0196056, published Oct. 1, 1986, and those of CKS are described in EPO Publication No. 0331961, published Sep. 13, 1989. Any desired portion of the nucleic acid sequence containing an open reading frame, in either sense strand, can be obtained as a recombinant protein, such as a mature or fusion protein; alternatively, a polypeptide encoded in the HGBV genome or cDNA can be provided by chemical synthesis.

The nucleic acid sequence encoding the desired polypeptide, whether in fused or mature form, and whether or not containing a signal sequence to permit secretion, may be ligated into expression vectors suitable for any convenient host. Both eucaryotic and prokaryotic host systems are used in the art to form recombinant proteins, and some of these are listed herein. The polypeptide then is isolated from lysed cells or from the culture medium and purified to the extent needed for its intended use. Purification can be performed by techniques known in the art, and include salt fractionation, chromatography on ion exchange resins, affinity chromatography, centrifugation, among others. Such polypeptides may be used as diagnostic reagents, or for passive immunotherapy. In addition, antibodies to these polypeptides are useful for isolating and identifying HGBV particles. The HGBV antigens also may be isolated from HGBV virions. These virions can be grown in HGBV infected cells in tissue culture, or in an infected individual.

Preparation of Antigenic Polypeptides and Conjugation with Solid Phase

An antigenic region or fragment of a polypeptide generally is relatively small, usually about 8 to 10 amino acids or less in length. Fragments of as few as 5 amino acids may characterize an antigenic region. These segments may correspond to regions of HGBV antigen. By using the HGBV genomic or cDNA sequences as a basis, nucleic acid sequences encoding short segments of HGBV polypeptides can be expressed recombinantly either as fusion proteins or as isolated polypeptides. These short amino acid sequences also can be obtained by chemical synthesis. The small chemically synthesized polypeptides may be linked to a suitable carrier molecule when the synthesized polypeptide provided is correctly configured to provide the correct epitope but too small to be antigenic. Linking methods are known in the art and include but are not limited to using N-succinimidyl-3-(2-pyrdylthio)propionate (SPDP) and succinimidyl 4-(N-maleimidomethyl)cyclohexane-1-carboxylate (SMCC). Polypeptides lacking sulfhydryl groups can be modified by adding a cysteine residue. These reagents create a disulfide linkage between themselves and peptide cysteine residues on one protein and an amide linkage through the epsilon-amino on a lysine, or other free amino group in the other. A variety of such disulfide/amide-forming agents are known. Other bifunctional coupling agents form a thioester rather than a disulfide linkage. Many of these thio-ether-forming agents are commercially available and are known to those of ordinary skill in the art. The carboxyl groups can be activated by combining them with succinimide or 1-hydroxyl-2-nitro-4-sulfonic acid, sodium salt. Any carrier which does not itself induce the production of antibodies harmful to the host can be used. Suitable carriers include proteins, polysaccharides such as latex functionalized sepharose, agarose, cellulose, cellulose beads, polymeric amino acids such as polyglutamic acid, polylysine, amino acid copolymers and inactive virus particles, among others. Examples of protein substrates include serum albumins, keyhole limpet hemocyanin, immunoglobulin molecules, thyroglobulin, ovalbumin, tetanus toxoid, and yet other proteins known to those skilled in the art.

Preparation of Hybrid Particle Immunogens Containing HGBV Epitopes

The immunogenicity of HGBV epitopes also may be enhanced by preparing them in mammalian or yeast systems fused with or assembled with particle-forming proteins such as those associated with HBV surface antigen. Constructs wherein the HGBV epitope is linked directly to the particle-forming protein coding sequences produce hybrids which are immunogenic with respect to the HGBV epitope. In addition, all of the vectors prepared include epitopes specific for HGBV, having varying degrees of immunogenicity. Particles constructed from particle forming protein which include HGBV sequences are immunogenic with respect to HGBV and HBV.

Hepatitis B surface antigen has been determined to be formed and assembled into particles in *S. cerevisiae* and mammalian cells; the formation of these particles has been reported to enhance the immunogenicity of the monomer subunit. P. Valenzuela et al., *Nature* 298:334 (1982); P. Valenzuela et al., in I. Millman et al., eds., *Hepatitis B,* Plenum Press, pp. 225–236 (1984). The constructs may include immunodominant epitopes of HBsAg. Such constructs have been reported expressible in yeast, and hybrids including heterologous viral sequences for yeast expression have been disclosed. See, for example, EPO 174,444 and EPO 174,261. These constructs also have been reported capable of being expressed in mammalian cells such as Chinese hamster ovary (CHO) cells. Michelle et al., *International Symposium on Viral Hepatitis*, 1984. In HGBV, portions of the particle-forming protein coding sequence may be replaced with codons encoding an HGBV epitope. In this replacement, regions that are not required to mediate the aggregation of the units to form immunogenic particles in yeast or mammals can be deleted, thus eliminating additional HGBV antigenic sites from competition with the HGBV epitope.

Vaccine Preparation

Vaccines may be prepared from one or more immunogenic polypeptides or nucleic acids derived from HGBV nucleic acid sequences or from the HGBV genome to which they correspond. Vaccines may comprise recombinant polypeptides containing epitope(s) of HGBV. These polypeptides may be expressed in bacteria, yeast or mammalian cells, or alternatively may be isolated from viral preparations. It also is anticipated that various structural proteins may contain epitopes of HGBV which give rise to protective anti-HGBV antibodies. Synthetic peptides therefore also can be utilized when preparing these vaccines. Thus, polypeptides containing at least one epitope of HGBV may be used, either singly or in combinations, in HGBV vaccines. It also is contemplated that nonstructural proteins as well as structural proteins may provide protection against viral pathogenicity, even if they do not cause the production of neutralizing antibodies.

Considering the above, multivalent vaccines against HGBV may comprise one or more structural proteins, and/or one or more nonstructural proteins. These vaccines may be comprised of, for example, recombinant HGBV polypeptides and/or polypeptides isolated from the virions and/or synthetic peptides. These immunogenic epitopes can be used in combinations, i.e., as a mixture of recombinant proteins, synthetic peptides and/or polypeptides isolated from the virion; these may be administered at the same or different time. Additionally, it may be possible to use inactivated HGBV in vaccines. Such inactivation may be be preparation of viral lysates, or by other means known in the art to cause inactivation of hepatitis-like viruses, for example, treatment with organic solvents or detergents, or treatment with formalin. Attenuated HGBV strain preparation also is disclosed in the present invention. It is contemplated that some of the proteins in HGBV may cross-react with other known viruses, and thus that shared epitopes may exist between HGBV and other viruses which would then give rise to protective antibodies against one or more of the disorders caused by these pathogenic agents. It is contemplated that it may be possible to design multiple purpose vaccines based upon this belief.

The preparation of vaccines which contain at least one immunogenic peptide as an active ingredient is known to one skilled in the art. Typically, such vaccines are prepared as injectables, either as liquid solutions or suspensions; solid forms suitable for solution in or suspension in liquid prior to injection also may be prepared. The preparation may be emulsified or the protein may be encapsulated in liposomes. The active immunogenic ingredients often are mixed with pharmacologically acceptable excipients which are compatible with the active ingredient. Suitable excipients include but are not limited to water, saline, dextrose, glycerol, ethanol and the like; combinations of these excipients in various amounts also may be used. The vaccine also may contain small amounts of auxiliary substances such as wetting or emulsifying reagents, pH buffering agents, and/or adjuvants which enhance the effectiveness of the vaccine. For example, such adjuvants can include aluminum hydroxide, N-acetyl-muramyl-L-threonyl-D-isoglutamine (thr-DMP), N-acetyl-nornuramyl-L-alanyl-D-isoglutamine (CGP 11687, also referred to as nor-MDP), N-acetylmuramyul-L-alanyl-D-isoglutaminyl-L-alanine-2-(1'2'-dipalmitoyl-sn-glycero-3-hydroxphosphoryloxy) ethylamine (CGP 19835A, also referred to as MTP-PE), and RIBI (MPL+TDM+CWS) in a 2% squalene/Tween-80® emulsion. The effectiveness of an adjuvant may be determined by measuring the amount of antibodies directed against an immunogenic polypeptide containing an HGBV antigenic sequence resulting from administration of this polypeptide in vaccines which also are comprised of the various adjuvants.

The vaccines usually are administered by intraveneous or intramuscular injection. Additional formulations which are suitable for other modes of administration include suppositories and, in some cases, oral formulations. For suppositories, traditional binders and carriers may include but are not limited to polyalkylene glycols or triglycerides. Such suppositories may be formed from mixtures containing the active ingredient in the range of about 0.5% to about 10%, preferably, about 1% to about 2%. Oral formulation include such normally employed excipients as, for example pharmaceutical grades of mannitol, lactose, starch, magnesium stearate, sodium saccharine, cellulose, magnesium carbonate and the like. These compositions may take the form of solutions, suspensions, tablets, pills, capsules, sustained release formulations or powders and contain about 10% to about 95% of active ingredient, preferably about 25% to about 70%.

The proteins used in the vaccine may be formulated into the vaccine as neutral or salt forms. Pharmaceutically acceptable salts such as acid addition salts (formed with free amino groups of the peptide) and which are formed with inorganic acids such as hydrochloric or phosphoric acids, or such organic acids such as acetic, oxalic, tartaric, maleic, and others known to those skilled in the art. Salts formed with the free carboxyl groups also may be derived from inorganic bases such as sodium, potassium, ammonium, calcium or ferric hydroxides and the like, and such organic bases such as isopropylamine, trimethylamine, 2-ethylamino ethanol, histidine procaine, and others known to those skilled in the art.

Vaccines are administered in a way compatible with the dosage formulation, and in such amounts as will be prophylactically and/or therapeutically effective. The quantity to be administered generally is in the range of about 5 micrograms to about 250 micrograms of antigen per dose, and depends upon the subject to be dosed, the capacity of the subject's immune system to synthesize antibodies, and the degree of protection sought. Precise amounts of active ingredient required to be administered also may depend upon the judgment of the practitioner and may be unique to each subject. The vaccine may be given in a single or multiple dose schedule. A multiple dose is one in which a primary course of vaccination may be with one to ten separate doses, followed by other doses given at subsequent time intervals required to maintain and/or to reinforce the immune response, for example, at one to four months for a second dose, and if required by the individual, a subsequent dose(s) after several months. The dosage regimen also will be determined, at least in part, by the need of the individual, and be dependent upon the practitioner's judgment. It is contemplated that the vaccine containing the immunogenic HGBV antigen(s) may be administered in conjunction with other immunoregulatory agents, for example, with immune globulins.

Preparation of Antibodies Against HGBV Epitopes

The immunogenic peptides prepared as described herein are used to produce antibodies, either polyclonal or monoclonal. When preparing polyclonal antibodies, a selected mammal (for example, a mouse, rabbit, goat, horse or the like) is immunized with an immunogenic polypeptide bearing at least one HGBV epitope. Serum from the immunized animal is collected after an appropriate incubation period and treated according to known procedures. If serum containing polyclonal antibodies to an HGBV epitope contains antibodies to other antigens, the polyclonal antibodies can be purified by, for example, immunoaffinity chromatography. Techniques for producing and processing polyclonal antibodies are known in the art and are described in, among others, Mayer and Walker, eds., *Immunochemical Methods In Cell and Molecular Biology,* Academic Press, London (1987). Polyclonal antibodies also may be obtained from a mammal previously infected with HGBV. An example of a method for purifying antibodies to HGBV epitopes from serum of an individual infected with HGBV using affinity chromatography is provided herein.

Monoclonal antibodies directed against HGBV epitopes also can be produced by one skilled in the art. The general methodology for producing such antibodies is well-known and has been described in, for example, Kohler and Milstein, *Nature* 256:494 (1975) and reviewed in J. G. R. Hurrel, ed., *Monoclonal Hybridoma Antibodies: Techniques and Applications,* CRC Press Inc., Boco Raton, Fla. (1982), as well as that taught by L. T. Mimms et al., *Virology* 176:604–619 (1990). Immortal antibody-producing cell lines can be created by cell fusion, and also by other techniques such as direct transformation of B lymphocytes with oncogenic DNA, or transfection with Epstein-Barr virus. See also, M. Schreier et al., Hybridoma Techniques, Scopes (1980) Protein Purification, Principles and Practice, 2nd Edition, Springer-Verlag, New York (1984); Hammerling et al., Monoclonal Antibodies and T-Cell Hybridomas (1981); Kennet et al., Monoclonal Antibodies (1980). Examples of uses and techniques of monoclonal antibodies are disclosed in U.S. patent applications Ser. Nos. 748,292; 748,563; 610,175, 648,473; 648,477; and 648,475.

Monoclonal and polyclonal antibodies thus developed, directed against HGBV epitopes, are useful in diagnostic and prognostic applications, and also, those which are neutralizing are useful in passive immunotherapy. Monoclonal antibodies especially can be used to produce anti-idiotype antibodies. These anti-idiotype antibodies are immunoglobulins which carry an “internal image” of the antigen of the infectious agent against which protection is desired. See, for example, A. Nisonoff et al., *Clin. Immunol. Immunopath.* 21:397–406 (1981), and Dreesman et al., *J. Infect. Dis.* 151:761 (1985). Techniques for raising such idiotype antibodies are known in the art and exemplified, for example, in Grych et al., *Nature* 316:74 (1985); MacNamara et al., *Science* 226:1325 (1984); and Uytdehaag et al., *J. Immunol.* 134:1225 (1985). These anti-idiotypic antibodies also may be useful for treatment of HGBV infection, as well as for elucidation of the immunogenic regions of HGBV antigens.

Diagnostic Oligonucleotide Probes and Kits

Using determined portions of the isolated HGBV nucleic acid sequences as a basis, oligomers of approximately eight nucleotides or more can be prepared, either by excision or synthetically, which hybridize with the HGBV genome and are useful in identification of the viral agent(s), further characterization of the viral genome, as well as in detection of the virus(es) in diseased individuals. The natural or derived probes for HGBV polynucleotides are a length which allows the detection of unique viral sequences by hybridization. While six to eight nucleotides may be a workable length, sequences of ten to twelve nucleotides are preferred, and those of about 20 nucleotides may be most preferred. These sequences preferably will derive from regions which lack heterogeneity. These probes can be prepared using routine, standard methods including automated oligonucleotide synthetic methods. A complement of any unique portion of the HGBV genome will be satisfactory. Complete complementarity is desirable for use as probes, although it may be unnecessary as the length of the fragment is increased.

When used as diagnostic reagents, the test sample to be analyzed, such as blood or serum, may be treated such as to extract the nucleic acids contained therein. The resulting nucleic acid from the sample may be subjected to gel electrophoresis or other size separation techniques; or, the nucleic acid sample may be dot-blotted without size separation. The probes then are labelled. Suitable labels and methods for attaching labels to probes are known in the art, and include but are not limited to radioactive labels incorporated by nick translation or kinasing, biotin, fluorescent and chemiluminescent probes. Examples of many of these labels are disclosed herein. The nucleic acids extracted from the sample then are treated with the labelled probe under hybridization conditions of suitable stringencies.

The probes can be made completely complementary to the HGBV genome. Therefore, usually high stringency conditions are desirable in order to prevent false positives. However, conditions of high stringency should be used only if the probes are complementary to regions of the HGBV genome which lack heterogeneity. The stringency of hybridization is determined by a number of factors during the washing procedure, including temperature, ionic strength, length of time and concentration of formamide. See, for example, J. Sambrook (supra). Hybridization can be carried out by a number of various techniques. Amplification can be performed, for example, by Ligase Chain Reaction (LCR), Polymerase Chain Reaction (PCR), Q-beta replicase, NASBA, etc.

It is contemplated that the HGBV genome sequences may be present in serum of infected individuals at relatively low levels, for example, approximately $10^2$–$10^3$ sequences per ml. This level may require that amplification techniques be used in hybridization assays, such as the Ligase Chain Reaction or the Polymerase Chain Reaction. Such techniques are known in the art. For example, the “Bio-Bridge” system uses terminal deoxynucleotide transferase to add unmodified 3'-poly-dT-tails to a nucleic acid probe (Enzo Biochem. Corp.). The poly dt-tailed probe is hybridized to the target nucleotide sequence, and then to a biotin-modified poly-A. Also, in EP 124221 there is described a DNA hybridization assay wherein the analyte is annealed to a single-stranded DNA probe that is complementary to an enzyme-labelled oligonucleotide, and the resulting tailed duplex is hybridized to an enzyme-labelled oligonucleotide. EP 204510 describes a DNA hybridization assay in which analyte DNA is contacted with a probe that has a tail, such as a poly-dT-tail, an amplifier strand that has a sequencethat hybridizes to to the tail of the probe, such as a poly-A sequence, and which is capable of binding a plurality of labelled strands. The technique first may involve amplification of the target HGBV sequences in sera to approximately $10^6$ sequences/ml. This may be accomplished by following the methods described by Saiki et al., *Nature* 324:163 (1986). The amplified sequence(s) then may be detected using a hybridization assay such as those known in the art. The probes can be packaged in diagnostic kits which include the probe nucleic acid sequence which sequence may be labelled; alternatively, the probe may be unlabelled and the ingredients for labelling could be included with the kit. The kit also may contain other suitably packaged reagents and materials needed or desirable for the particular hybridization protocol, for example, standards as well as instructions for performing the assay.

Other known amplification methods which can be utilized herein include but are not limited to the so-called "NASBA" or "3SR" technique taught in *PNAS USA* 87:1874–1878 (1990) and also discussed bin *Nature:*350 (No. 6313):91–92 (1991) and Q-beta replicase. Flourescence in situ hybridization ("FISH") also can be performed utilizing the reagents described herein. In situ hybridization involves taking morphologically intact tissues, cells or chromosomes through the nucleic acid hybridization process to demonstrate the presence of a particular piece of genetic information and its specific location within individual cells. Since it does not require homogenization of cells and extraction of the target sequence, it provides precise localization and distribution of a sequence in cell populations. In situ hybridization can identify the sequence of interest concentrated in the cells containing it. It also can identify the type and fraction of the cells in a heterogeneous cell population containing the sequence of interest. DNA and RNA can be detected with the same assay reagents. PNAs can be utilized in FISH methods to detect targets without the need for amplification. If increased signal is desired, mutiple fluorophores can be used to increase signal and thus, sensitivity of the method. Various methods of FISH are known, including a one-step method using multiple oligonucleotides or the conventional multi-step method. It is within the scope of the present invention that these types of methods can be automated by various means including flow cytometry and image analysis.

Immunoassay and Diagnostic Kits

Both the polypeptides which react immunologically with serum containing HGBV antibodies and composites thereof, and the antibodies raised against the HGBV specific epitopes in these polypeptides are useful in immunoassays to detect the presence of HGBV antibodies, or the presence of the virus and/or viral antigens in biological test samples. The design of these immunoassays is subject to variation, and a variety of these are known in the art; a variety of these have been described herein. The immunoassay may utilize one viral antigen, such as a polypeptide derived from any clone-containing HGBV nucleic acid sequence, or from the composite nucleic acid sequences derived from the HGBV nucleic acid sequences in these clones, or from the HGBV genome from which the nucleic acid sequences in these clones is derived. Or, the immunoassay may use a combination of viral antigens derived from these sources. It may use, for example, a monoclonal antibody directed against the same viral antigen, or polyclonal antibodies directed against different viral antigens. Assays can include but are not limited to those based on competition, direct reaction or sandwich-type assays. Assays may use solid phases or may be performed by immunoprecipitation or any other methods which do not utilize solid phases. Examples of assays which utilize labels as the signal generating compound and those labels are described herein. Signals also may be amplified by using biotin and avidin, enzyme labels or biotin anti-biotin systems, such as that described in pending U.S. patent application Ser. Nos. 608,849; 070,647; 418,981; and 687, 785. Recombinant polypeptides which include epitopes from immunodominant regions of HGBV may be useful for the detection of viral antibodies in biological test samples of infected individuals. It also is contemplated that antibodies may be useful in discriminating acute from non-acute infections. Kits suitable for immunodiagnosis and containing the appropriate reagents are constructed by packaging the appropriate materials, including the polypeptides of the invention containing HGBV epitopes or antibodies directed against HGBV epitopes in suitable containers, along with the remaining reagents and materials required for the conduct of the assay, as well as suitable assay instructions.

Assay formats can be designed which utilize the recombinant proteins detailed herein, and although we describe and detail CKS proteins, it also is comtemplated that other expression systems, such as superoxide dismutase (SOD), and others, can be used in the present invention to generate fusion proteins capable of use in a variety of ways, including as antigens in immunoassays, immunogens for antibody production, and the like. In an assay format to detect the presence of antibody against a specific analyte (for example, an infectious agent such as a virus) in a human test sample, the human test sample is contacted and incubated with a solid phase coated with at least one recombinant protein (polypeptide). If antibodies are present in the test sample, they will form a complex with the antigenic polypeptide and become affixed to the solid phase. After the complex has formed, unbound materials and reagents are removed by washing the solid phase. The complex is reacted with an indicator reagent and allowed to incubate for a time and under conditions for second complexes to form. The presence of antibody in the test sample to the CKS recombinant polypeptide(s) is determined by detecting the signal generated. Signal generated above a cut-off value is indicative of antibody to the analyte present in the test sample. With many indicator reagents, such as enzymes, the amount of antibody present is proportional to the signal generated. Depending upon the type of test sample, it may be diluted with a suitable buffer reagent, concentrated, or contacted with the solid phase without any manipulation ("neat"). For example, it usually is preferred to test serum or plasma samples which previously have been diluted, or concentrate specimens such as urine, in order to determine the presence and/or amount of antibody present.

In addition, more than one recombinant protein can be used in the assay format just described to test for the presence of antibody against a specific infectious agent by utilizing CKS fusion proteins against various antigenic epitopes of the viral genome of the infectious agent under study. Thus, it may be preferred to use recombinant polypeptides which contain epitopes within a specific viral antigenic region as well as epitopes from other antigenic regions from the viral genome to provide assays which have increased sensitivity and perhaps greater specificity than using a polypeptide from one epitope. Such an assay can be utilized as a confirmatory assay. In this particular assay format, a known amount of test sample is contacted with (a) known amount(s) of at least one solid support coated with at least one recombinant protein for a time and under conditions sufficient to form recombinant protein/antibody complexes. The complexes are contacted with known amount(s) of appropriate indicator reagent(s)s for a time and under suitable conditions for a reaction to occur, wherein the resultant signal generated is compared to a negative test sample in order to determine the presence of antibody to the analyte in the test sample. It further is contemplated that, when using certain solid phases such as microparticles, each recombinant protein utilized in the assay can be attached to a separate microparticle, and a mixture of these microparticles made by combining the various coated microparticles, which can be optimized for each assay.

Variations to the above-described assay formats include the incorporation of CKS-recombinant proteins of different analytes attached to the same or to different solid phases for the detection of the presence of antibody to either analyte (for example, CKS-recombinant proteins specific for certain antigenic regions of one infective agent coated on the same or different solid phase with CKS-recombinant proteins specific for certain antigenic region(s) of a different infective agent, to detect the presence of either (or both) infective agents.

In yet another assay format, CKS recombinant proteins containing antigenic epitopes are useful in competitive assays such as neutralization assays. To perform a neutralization assay, a recombinant polypeptide representing epitopes of an antigenic region of an infectious agent such as a virus, is solubilized and mixed with a sample diluent to a final concentration of between 0.5 to 50.0 µg/ml. A known amount of test sample (preferably 10 µl), either diluted or non-diluted, is added to a reaction well, followed by 400 µl of the sample diluent containing the recombinant polypeptide. If desired, the mixture may be preincubated for approximately 15 minutes to two hours. A solid phase coated with the CKS recombinant protein described herein then is added to the reaction well, and incubated for one hour at approximately 40° C. After washing, a known amount of an indicator reagent, for example, 200 µl of a peroxidase labelled goat anti-human IgG in a conjugate diluent is added and incubated for one hour at 40° C. After washing and when using an enzyme conjugate such as described, an enzyme substrate, for example, OPD substrate, is added and incubated at room temperature for thirty minutes. The reaction is terminated by adding a stopping reagent such as 1N sulfuric acid to the reaction well. Absorbance is read at 492 nm. Test samples which contain antibody to the specific polypeptide generate a reduced signal caused by the competitive binding of the peptides to these antibodies in solution. The percentage of competitive binding may be calculated by comparing absorbance value of the sample in the presence of recombinant polypeptide to the absorbance value of the sample assayed in the absence of a recombinant polypeptide at the same dilution. Thus, the difference in the signals generated between the sample in the presence of recombinant protein and the sample in the absence of recombinant protein is the measurement used to determine the presence or absence of antibody.

In another assay format, the recombinant proteins can be used in immunodot blot assay systems. The immunodot blot assay system uses a panel of purified recombinant polypeptides placed in an array on a nitrocellulose solid support. The prepared solid support is contacted with a sample and captures specific antibodies (specific binding member) to the recombinant protein (other specific binding member) to form specific binding member pairs. The captured antibodies are detected by reaction with an indicator reagent. Preferably, the conjugate specific reaction is quantified using a reflectance optics assembly within an instrument which has been described in U.S. patent application Ser. No. 07/227,408 filed Aug. 2, 1988. The related U.S. patent application Ser. Nos. 07/227,586 and 07/227,590 (both of which were filed on Aug. 2, 1988) further described specific methods and apparatus useful to perform an immunodot assay, as well as U.S. Pat. No. 5,075,077 (U.S. Ser. No. 07/227,272 filed Aug. 2, 1988), which enjoys common ownership and is incorporated herein by reference. Briefly, a nitrocellulose-base test cartridge is treated with multiple antigenic polypeptides. Each polypeptide is contained within a specific reaction zone on the test cartridge. After all the antigenic polypeptides have been placed on the nitrocellulose, excess binding sites on the nitrocellulose are blocked. The test cartridge then is contacted with a test sample such that each antigenic polypeptide in each reaction zone will react if the test sample contains the appropriate antibody. After reaction, the test cartridge is washed and any antigen-antibody reactions are identified using suitable well-known reagents. As described in the patents and patent applications listed herein, the entire process is amenable to automation. The specifications of these applications related to the method and apparatus for performing an immunodot blot assay are incorporated herein by reference.

CKS fusion proteins can be used in assays which employ a first and second solid support, as follow, for detecting antibody to a specific antigen of an analyte in a test sample. In this assay format, a first aliquot of a test sample is contacted with a first solid support coated with CKS recombinant protein specific for an analyte for a time and under conditions sufficient to form recombinant protein/analyte antibody complexes. Then, the complexes are contacted with an indicator reagent specific for the recombinant antigen. The indicator reagent is detected to determine the presence of antibody to the recombinant protein in the test sample. Following this, the presence of a different antigenic determinant of the same analyte is determined by contacting a second aliquot of a test sample with a second solid support coated with CKS recombinant protein specific for the second antibody for a time and under conditions sufficient to form recombinant protein/second antibody complexes. The complexes are contacted with a second indicator reagent specific for the antibody of the complex. The signal is detected in order to determine the presence of antibody in the test sample, wherein the presence of antibody to either analyte recombinant protein, or both, indicates the presence of anti-analyte in the test sample. It also is contemplated that the solid supports can be tested simultaneously.

The use of haptens is known in the art. It is contemplated that haptens also can be used in assays employing CKS fusion proteins in order to enhance performance of the assay.
Further Characterization of the HGBV Genome, Virions, and Viral Antigens Using Probes The HGBV nucleic acid sequences may be used to gain further information on the sequence of the HGBV genome, and for identification and isolation of the HGBV agent. Thus, it is contemplated that this knowledge will aid in the characterization of HGBV including the nature of the HGBV genome, the structure of the viral particle, and the nature of the antigens of which it is composed. This information, in turn, can lead to additional polynucleotide probes, polypeptides derived from the HGBV genome, and antibodies directed against HGBV epitopes which would be useful for the diagnosis and/or treatment of HGBV caused non-A, non-B, non-C, non-D and non-E hepatitis.

The nucleic acid sequence information is useful for the design of probes or PCR primers for the isolation of additional nucleic acid sequences which are derived from yet undefined regions of the HGBV genome. For example, PCR primers or labelled probes containing a sequence of 8 or more nucleotides, and preferably 20 or more nucleotides, which are derived from regions close to the 5'-termini or 3'-termini of the family of HGBV nucleic acid sequences may be used to isolate overlapping nucleic acid sequences from HGBV genomic or cDNA libraries or directly from viral nucleic acid. These sequences which overlap the HGBV nucleic acid sequences, but which also contain sequences derived from regions of the genome from which the above-mentioned HGBV nucleic acid sequence are not derived, may then be used to synthesize probes for identification of other overlapping fragments which do not necessarily overlap the nucleic acid sequences in the clones. Unless the HGBV genome is segmented and the segments lack common sequences, it is possible to sequence the entire viral genome(s) utilizing the technique of isolation of overlapping nucleic acid sequences derived from the viral genome(s). Characterization of the genomic segments alternatively could be from the viral genome(s) isolated from purified HGBV particles. Methods for purifying HGBV particles and for detecting them during the purification procedure are described herein. Procedures for isolating polynucleotide genomes from viral particles are well-known in the art. The isolated genomic segments then could be cloned and sequenced. Thus, it is possible to clone and sequence the HGBV genome(s) irrespective of their nature.

Methods for constructing HGBV genomic or cDNA libraries are known in the art, and vectors useful for this purpose are known in the art. These vectors include lambda-gt11, lambda-gt10, and others. The HGBV derived nucleic acid sequence detected by the probes derived from the HGBV genomic or cDNAs, may be isolated from the clone by digestion of the isolated polynucleotide with the appropriate restriction enzyme(s), and sequenced.

The sequence information derived from these overlapping HGBV nucleic acid sequences is useful for determining areas of homology and heterogeneity within the viral genome(s), which could indicate the presence of different strains of the genome and or of populations of defective particles. It is also useful for the design of hybridization probes to detect HGBV or HGBV antigens or HGBV nucleic acids in biological samples, and during the isolation of HGBV, utilizing the techniques described herein. The overlapping nucleic acid sequences may be used to create expression vectors for polypeptides derived from the HGBV genome(s). Encoded within the family of nucleic acid sequences are antigen(s) containing epitopes which are contemplated to be unique to HGBV, i.e., antibodies directed against these antigens are absent from individuals infected with HAV, HBV, HCV, and HEV, and with the genomic sequences in GenBank are contemplated to indicate that minimal homology exists between these nucleic acid sequences and the polynucleotide sequences of those sources. Thus, antibodies directed against the antigens encoded with the HGBV nucleic acid sequences may be used to identify the non-A, non-B, non-C, non-D and non-E particle isolated from infected individuals. In addition, they also are useful for the isolation of the HGBV agent(s).

HGBV particles may be isolated from the sera of infected individuals or from cell cultures by any of the methods known in the art, including, for example, techniques based on size discrimination such as sedimentation or exclusion methods, or techniques based on density such as ultracentrifugation in density gradients, or precipitation with agents such as polyethylene glycol (PEG), or chromatography on a variety of materials such as anionic or cationic exchange materials, and materials which bind due to hydrophobic interactions, as well as affinity columns. During the isolation procedure the presence of HGBV may be detected by hybridization analysis of the extracted genome, using probes derived from HGBV nucleic acid sequences or by immunoassay which utilize as probes antibodies directed against HGBV antigens encoded within the family of HGBV nucleic acid sequences. The antibodies may be polyclonal or monoclonal, and it may be desirable to purify the antibodies before their use in the immunoassay. Such antibodies directed against HGBV antigens which are affixed to solid phases are useful for the isolation of HGBV by immunoaffinity chromatography. Methods for immunoaffinity chromatography are known in the art, and include methods for affixing antibodies to solid phases so that they retain their immunoselective activity. These methods include adsorption, and covalent binding. Spacer groups may be included in the bifunctional coupling agents such that the antigen binding site of the antibody remains accessible.

During the purification procedure the presence of HGBV may be detected and/or verified by nucleic acid hybridization or PCR, utilizing as probes or primers polynucleotides derived from a family of HGBV genomic or cDNA sequences, as well as from overlapping HGBV nucleic acid sequences. Fractions are treated under conditions which would cause the disruption of viral particles, such as by use of detergents in the presence of chelating agents, and the presence of viral nucleic acid determined by hybridization techniques or PCR. Further confirmation that the isolated particles are the agents which induce HGBV infection may be obtained by infecting an individual which is preferably a tamarin with the isolated virus particles, followed by a determination of whether the symptoms of non-A, non-B, non-C, non-D and non-E hepatitis, as described herein, result from the infection.

Such viral particles obtained from the purified preparations then may be further characterized. The genomic nucleic acid, once purified, can be tested to determine its sensitivity to RNAse or DNAse I; based on these tests, the determination of HGBV as a RNA genome or DNA genome may be made. The strandedness and circularity or non-circularity can be determined by methods known in the art including its visualization by electron microscopy, its migration in density gradients and its sedimentation characteristics. From hybridization of the HGBV genome, the negative or positive strandedness of the purified nucleic acid can be determined. In addition, the purified nucleic acid can be cloned and sequenced by known techniques, including reverse transcriptase, if the genomic material is RNA. Utilizing the nucleic acid derived from the viral particles, it then is possible to sequence the entire genome, whether or not it is segmented.

Determination of polypeptides containing conserved sequences may be useful for selecting probes which bind the HGBV genome, thus allowing its isolation. In addition, conserved sequences in conjunction with those derived from the HGBV nucleic acid sequences, may be used to design primers for use in systems which amplify genomic sequences. Further, the structure of HGBV also may be determined and its components isolated. The morphology and size may be determined by electron microscopy, for example. The identification and localization of specific viral polypeptide antigens such as envelope (coat) antigens, or internal antigens such as nucleic acid binding proteins or core antigens, and polynucleotide polymerase(s) also may be determined by ascertaining whether the antigens are present in major or minor viral components, as well as by utilizing antibodies directed against the specific antigens encoded within isolated nucleic acid sequences as probes. This information may be useful for diagnostic and therapeutic applications. For example, it may be preferable to include an exterior antigen in a vaccine preparation, or perhaps multivalent vaccines may be comprised of a polypeptide derived from the genome encoding a structural protein as well as a polypeptide from another portion of the genome, such as a nonstructural polypeptide.

Cell Culture Systems and Animal Model Systems for HGBV Replication

Generally, suitable cells or cell lines for culturing HGBV may include the following: monkey kidney cells such as MK2 and VERO, porcine kidney cell lines such as PS, baby hamster kidney cell lines such as BHK, murine macrophage cell lines such as P388D1, MK1 and Mm1, human macrophage cell lines such as U-937, human peripheral blood leukocytes, human adherent monocytes, hepatocytes or hepatocytic cell lines such as HUH7 and HepG2, embryos or embryonic cell such as chick embryo fibroblasts or cell lines derived from invertebrates, preferably from insects such as Drosophia cell lines or more preferably from arthropods such as mosquito cell lines or tick cell lines It also is possible that primary hepatocytes can be cultured and then infected with HGBV. Alternatively, the hepatocyte cultures could be derived from the livers of infected individuals (human or tamarins). That latter case is an example of a cell line which is infected in vivo being passaged in vitro. In addition, various immortalization methods can be used to obtain cell lines derived from hepatocyte cultures. For example, primary liver cultures (before and after enrichment of the hepatocyte population) may be fused to a variety of cells to maintain stability. Also, cultures may be infected with transforming viruses, or transfected with transforming genes in order to create permanent or semipermanent cell lines. In addition, cells in liver cultures may be fused to established cell lines such as $PehG_2$. Methods for cell fusion are well-known to the routineer, and include the use of fusion agents such as PEG and Sendai Virus, among others.

It is contemplated that HGBV infection of cell lines may be accomplished by techniques such as incubating the cells with viral preparations under conditions which allow viral entry into the cell. It also may be possible to obtain viral production by transfecting the cells with isolated viral polynucleotides. Methods for transfecting tissue culture cells are known in the art and include but are not limited to techniques which use electroporation and precipitation with DEAE-Dextran or calcium phosphate. Transfection with cloned HGBV genomic or cDNA should result in viral replication and the in vitro propagation of the virus. In addition to cultured cells, animal model systems may be used for viral replication. HGBV replication thus may occur in chimpanzees and also in, for example, marmosets and suckling mice.

Screening for Anti-Viral Agents for HGBV

The availability of cell culture and animal model systems for HGBV also renders screening for anti-viral agents which inhibit HGBV replication possible, and particularly for those agents which preferentially allow cell growth and multiplication while inhibiting viral replication. These screening methods are known in the art. Generally, the anti-viral agents are tested at a variety of concentrations, for their effect on preventing viral replication in cell culture systems which support viral replication, and then for an inhibition of infectivity or of viral pathogenicity, and a low level of toxicity, in an animal model system. The methods and composition provided herein for detecting HGBV antigens and HGBV polynucleotides are useful for screening of anti-viral agents because they provide an alternative, and perhaps a more sensitive means, for detecting the agent's effect on viral replication than the cell plaque assay or $ID_{50}$ assay. For example, the HGBV polynucleotide probes described herein may be used to quantitate the amount of viral nucleic acid produced in a cell culture. This could be performed by hybridization or competition hybridization of the infected cell nucleic acids with a labelled HGBV polynucleotide probe. Also, anti-HGBV antibodies may be used to identify and quantitate HGBV antigen(s) in the cell culture utilizing the immunoassays described herein. Also, since it may be desirable to quantitate HGBV antigens in the infected cell culture by a competition assay, the polypeptides encoded within the HGBV nucleic acid sequences described herein are useful for these assays. Generally, a recombinant HGBV polypeptide derived from the HGBV genomic or cDNA would be labelled, and the inhibition of binding of this labelled polypeptide to an HGBV polypeptide due to the antigen produced in the cell culture system would be monitored. These methods are especially useful in cases where the HGBV may be able to replicate in a cell lines without causing cell death.

Preparation of Attenuated Strains of HGBV

It may be possible to isolate attenuated strains of HGBV by utilizing the tissue culture systems and/or animal models systems provided herein. These attenuated strains would be useful for vaccines, or for the isolation of viral antigens. Attenuated strains are isolatable after multiple passages in cell culture and/or an animal model. Detection of an attenuated strain in an infected cell or individual is achievable by following methods known in the art and could include the use of antibodies to one or more epitopes encoded in HGBV as a probe or the use of a polynucleotide containing an HGBV sequence of at least about 8 nucleotides in length as a probe. Also or alternatively, an attenuated strain may be constructed utilizing the genomic information of HGBV provided herein, and utilizing recombinant techniques. Usually an attempt is made to delete a region of the genome encoding a polypeptide related to pathogenicity but not to viral replication. The genomic construction would allow the expression of an epitope which gives rise to neutralizing antibodies for HGBV. The altered genome then could be used to transform cells which allow HGBV replication, and the cells grown under conditions to allow viral replication. Attenuated HGBV strains are useful not only for vaccine purposes, but also as sources for the commercial production of viral antigens, since the processing of these viruses would require less stringent protection measures for the employees involved in viral production and/or the production of viral products.

Hosts and Expression Control Sequences

Although the following are known in the art, included herein are general techniques used in extracting the genome from a virus, preparing and probing a genomic library, sequencing clones, constructing expression vectors, transforming cells, performing immunological assays, and for growing cell in culture.

Both prokaryotic and eukaryotic host cells may be used for expression of desired coding sequences when appropriate control sequences which are compatible with the designated host are used. Among prokaryotic hosts, *E. coli* is most frequently used. Expression control sequences for prokaryotics include promoters, optionally containing operator portions, and ribosome binding sites. Transfer vectors compatible with prokaryotic hosts are commonly derived from the plasmid pBR322 which contains operons conferring ampicillin and tetracycline resistance, and the various pUC vectors, which also contain sequences conferring antibiotic resistance markers. These markers may be used to obtain successful transformants by selection. Commonly used prokaryotic control sequences include the beta-lactamase (penicillinase), lactose promoter system (Chang et al., *Nature* 198:1056 [1977]) the tryptophan promoter system (reported by Goeddel et al., *Nucleic Acid Res* 8:4057 [1980]) and the lambda-derived P1 promoter and N gene ribosome binding site (Shimatake et al., *Nature* 292:128 [1981]) and the hybrid Tac promoter (De Boer et al., *Proc. Natl. Acad. Sci. USA* 292:128 [1983]) derived from sequences of the trp and lac UV5 promoters. The foregoing systems are particularly compatible with *E. coli;* however, other prokaryotic hosts such as strains of Bacillus or Pseudomonas may be used if desired, with corresponding control sequences.

Eukaryotic hosts include yeast and mammalian cells in culture systems. *Saccharomyces cerevisiae* and *Saccharomyces carlsbergensis* are the most commonly used yeast hosts, and are convenient fungal hosts. Yeast compatible vectors carry markers which permit selection of successful transformants by conferring protrophy to auxotrophic mutants or resistance to heavy metals on wild-type strains. Yeast compatible vectors may employ the 2 micron origin of replication (as described by Broach et al., *Meth. Enz.* 101:307 [1983]), the combination of CEN3 and ARS1 or other means for assuring replication, such as sequences which will result in incorporation of an appropriate fragment into the host cell genome. Control sequences for yeast vectors are known in the art and include promoters for the synthesis of glycolytic enzymes, including the promoter for 3 phosphohycerate kinase. See, for example, Hess et al., *J. Adv. Enzyme Reg.* 7: 149 (1968), Holland et al., *Biochemistry* 17:4900 (1978) and Hitzeman *J. Biol. Chem.* 255:2073 (1980). Terminators also may be included, such as those derived from the enolase gene as reported by Holland, *J. Biol. Chem.* 256:1385 (1981). It is contemplated that particularly useful control systems are those which comprise the glyceraldehyde-3 phosphate dehydrogenase (GAPDH) promoter or alcohol dehydrogenase (ADH) regulatable promoter, terminators also derived from GAPDH, and if secretion is desired, leader sequences from yeast alpha factor. In addition, the transcriptional regulatory region and the transcriptional initiation region which are operably linked may be such that they are not naturally associated in the wild-type organism.

Mammalian cell lines available as hosts for expression are known in the art and include many immortalized cell lines which are available from the American Type Culture Collection. These include HeLa cells, Chinese hamster ovary (CHO) cells, baby hamster kidney (BHK) cells, and others. Suitable promoters for mammalian cells also are known in the art and include viral promoters such as that from Simian Virus 40 (SV40), Rous sarcoma virus (RSV), adenovirus (ADV), bovine papilloma virus (BPV), cytomegalovirus (CMV). Mammalian cells also may require terminator sequences and poly A addition sequences; enhancer sequences which increase expression also may be included, and sequences which cause amplification of the gene also may be desirable. These sequences are known in the art. Vectors suitable for replication in mammalian cells may include viral replicons, or sequences which insure integration of the appropriate sequences encoding non-A, non-B, non-C, non-D, non-E epitopes into the host genome. An example of a mammalian expression system for HCV is described in U.S. patent application Ser. No. 07/830,024, filed Jan. 31, 1992.

Transformations

Transformation may be by any known method for introducing polynucleotides into a host cell, including packaging the polynucleotide in a virus and transducing a host cell with the virus, and by direct uptake of the polynucleotide. The transformation procedures selected depends upon the host to be transformed. Bacterial transformation by direct uptake generally employs treatment with calcium or rubidium chloride. Cohen, *Proc. Natl. Acad. Sci. USA* 69:2110 (1972). Yeast transformation by direct uptake may be conducted using the calcium phosphate precipitation method of Graham et al., *Virology* 52:526 (1978), or modification thereof.

Vector Construction

Vector construction employs methods known in the art. Generally, site-specific DNA cleavage is performed by treating with suitable restriction enzymes under conditions which generally are specified by the manufacturer of these commercially available enzymes. Usually, about 1 microgram ($\mu$g) of plasmid or DNA sequence is cleaved by 1–10 units of enzyme in about 20 $\mu$l of buffer solution by incubation at 37° C. for 1 to 2 hours. After incubation with the restriction enzyme, protein is removed by phenol/chloroform extraction and the DNA recovered by precipitation with ethanol. The cleaved fragments may be separated using polyacrylamide or agarose gel electrophoresis methods, according to methods known by the routineer.

Sticky end cleavage fragments may be blunt ended using *E. coli* DNA polymerase 1 (Klenow) in the presence of the appropriate deoxynucleotide triphosphates (dNTPs) present in the mixture. Treatment with S1 nuclease also may be used, resulting in the hydrolysis of any single stranded DNA portions.

Ligations are performed using standard buffer and temperature conditions using T4 DNA ligase and ATP. Sticky end ligations require less ATP and less ligase than blunt end ligations. When vector fragments are used as part of a ligation mixture, the vector fragment often is treated with bacterial alkaline phosphatase (BAP) or calf intestinal alkaline phosphatase to remove the 5'-phosphate and thus prevent religation of the vector. Or, restriction enzyme digestion of unwanted fragments can be used to prevent ligation. Ligation mixtures are transformed into suitable cloning hosts such as *E. coli* and successful transformants selected by methods including antibiotic resistance, and then screened for the correct construction.

Construction of Desired DNA Sequences

Synthetic oligonucleotides may be prepared using an automated oligonucleotide synthesizer such as that described by Warner, *DNA* 3:401 (1984). If desired, the synthetic strands may be labelled with $^{32}$P by treatment with polynucleotide kinase in the presence of $^{32}$P-ATP, using standard conditions for the reaction. DNA sequences including those isolated from genomic or cDNA libraries, may be modified by known methods which include site directed mutagenesis as described by Zoller, *Nucleic Acids Res.* 10:6487 (1982). Briefly, the DNA to be modified is packaged into phage as a single stranded sequence, and converted to a double stranded DNA with DNA polymerase using, as a primer, a synthetic oligonucleotide complementary to the portion of the DNA to be modified, and having the desired modification included in its own sequence. Culture of the transformed bacteria, which contain replications of each strand of the phage, are plated in agar to obtain plaques. Theoretically, 50% of the new plaques contain phage having the mutated sequence, and the remaining 50% have the original sequence. Replicates of the plaques are hybridized to labelled synthetic probe at temperatures and conditions suitable for hybridization with the correct strand, but not with the unmodified sequence. The sequences which have been identified by hybridization are recovered and cloned.

Hybridization with Probe

HGBV genomic or DNA libraries may be probed using the procedure described by Grunstein and Hogness, *Proc. Natl. Acad. Sci. USA* 73:3961 (1975). Briefly, the DNA to be probed is immobilized on nitrocellulose filters, denatured and prehybridized with a buffer which contains 0–50% formamide, 0.75 M NaCl, 75 mM Na citrate, 0.02% (w/v) each of bovine serum albumin (BSA), polyvinyl pyrollidone and Ficoll, 50 mM Na Phosphate (pH 6.5), 0.1% SDS and 100 µg/ml carrier denatured DNA. The percentage of formamide in the buffer, as well as the time and temperature conditions of the prehybridization and subsequent hybridization steps depends on the stringency required. Oligomeric probes which require lower stringency conditions are generally used with low percentages of formamide, lower temperatures, and longer hybridization times. Probes containing more than 30 or 40 nucleotides such as those derived from cDNA or genomic sequences generally employ higher temperatures, for example, about 40 to 42° C., and a high percentage, for example, 50% formamide. Following prehybridization, a $^{32}$P-labelled oligonucleotide probe is added to the buffer, and the filters are incubated in this mixture under hybridization conditions. After washing, the treated filters are subjected to autoradiography to show the location of the hybridized probe. DNA in corresponding locations on the original agar plates is used as the source of the desired DNA.

Verification of Construction and Sequencing

For standard vector constructions, ligation mixtures are transformed into *E. coli* strain XL-1 Blue or other suitable host, and successful transformants selected by antibiotic resistance or other markers. Plasmids from the transformants then are prepared according to the method of Clewell et al., *Proc. Natl. Acad. Sci. USA* 62:1159 (1969) usually following chloramphenicol amplification as reported by Clewell et al., *J. Bacteriol.* 110:667 (1972). The DNA is isolated and analyzed usually by restriction enzyme analysis and/or sequencing. Sequencing may be by the well-known dideoxy method of Sanger et al., *Proc. Natl. Acad. Sci. USA* 74:5463 (1977) as further described by Messing et al., *Nucleic Acid Res.* 9:309 (1981), or by the method reported by Maxam et al., *Methods in Enzymology* 65:499 (1980). Problems with band compression, which are sometimes observed in GC rich regions, are overcome by use of T-deazoguanosine according to the method reported by Barr et al., *Biotechniques* 4:428 (1986).

Enzyme-Linked Immunosorbent Assay

Enzyme-linked immunosorbent assay (ELISA) can be used to measure either antigen or antibody concentrations. This method depends upon conjugation of an enzyme label to either an antigen or antibody, and uses the bound enzyme activity (signal generated) as a quantitative label (measurable generated signal). Methods which utilize enzymes as labels are described herein, as are examples of such enzyme labels.

Preparation of HGBV Nucleic Acid Sequences

The source of the non-A, non-B, non-C, non-D, non-E agent is an individual or pooled plasma, serum or liver homogenate from a human or tamarin infected with the HGBV virus meeting the clinical and laboratory criteria described herein. A tamarin alternatively can be experimentally infected with blood from another individual with non-A, non-B,non-C, non-E hepatitis meeting the criteria described hereinbelow. A pool can be made by combining many individual plasma, serum or liver homogenate samples containing high levels of alanine transferase activity; this activity results from hepatic injury due to HGBV infection. The TID (tamarin infective dose) of the virus has been calculated from one of our experiments to be $\geqq 4\times10^5$/ml (see Example 2, below).

For example, a nucleic acid library from plasma, serum or liver homogenate, preferably but not necessarily high titer, is generated as follows. First, viral particles are isolated from the plasma, serum or liver homogenate; then an aliquot is diluted in a buffered solution, such as one containing 50 mM Tris-HCl, pH 8.0, 1 mM EDTA, 100 mM NaCl. Debris is removed by centrifugation, for example, for 20 minutes at 15,000×g at 20° C. Viral particles in the resulting supernatant then are pelleted by centrifugation under appropriate conditions which can be determined routinely by one skilled in the art. To release the viral genome, the particles are disrupted by suspending the pellets in an aliquot of an SDS suspension, for example, one containing 1% SDS, 120 mM EDTA, 10 mM Tris-HCl, pH 7.5, which also contains 2 mg/ml proteinase K, which is followed by incubation at appropriate conditions, for example, 45° C. for 90 minutes. Nucleic acids are isolated by adding, for example, 0.8 μg MS2 bacteriophage RNA as carrier, and extracting the mixture four times with a 1:1 mixture of phenol:chloroform (phenol saturated with 0.5M Tris-HCl, pH 7.5, 0.1% (v/v) beta-mercaptoethanol, 0.1% (w/v) hydroxyquinolone, followed by extraction two times with chloroform. The aqueous phase is concentrated with, for example, 1-butanol prior to precipitation with 2.5 volumes of absolute ethanol overnight at −20° C. Nucleic acids are recovered by centrifugation in, for example, a Beckman SW41 rotor at 40,000 rpm for 90 min at 4° C., and dissolved in water that is treated with 0.05% (v/v) diethylpyrocarbonate and autoclaved.

Nucleic acid obtained by the above procedure is denatured with, for example, 17.5 mM $CH_3HgOH$; cDNA then is synthesized using this denatured nucleic acid as template, and is cloned into the EcoRI site of phage lambda-gt11, for example, by using methods described by Huynh (1985) supra, except that random primers replace oligo(dT) 12–18 during the synthesis of the first nucleic acid strand by reverse transcriptase (see Taylor et al., [1976]). The resulting double stranded nucleic acid sequences are fractionated according to size on a Sepharose CL-4B column, for example. Eluted material of approximate mean size 400, 300, 200 and 100 base-pairs are pooled into genomic pools. The lambdagt-gt11 cDNA library is generated from the cDNA in at least one of the pools. Alternatively, if the etiological agent is a DNA virus, methods for cloning genomic DNA may be useful and are known to those skilled in the art.

The so-generated lambda-gt11 genomic library is screened for epitopes that can bind specifically with serum, plasma or a liver homogenate from an individual who had previously experienced non-A, non-B, non-C, non-E hepatitis (one which meets the criteria as set forth hereinbelow). About $10^4$–$10^7$ phage are screened with sera, plasma, or liver homogenates using the methods of Huyng et al. (supra). Bound human antibody can be detected with sheep anti-human Ig antisera that is radio-labelled with $^{125}$I or other suitable reporter molecules including HRPO, alkaline phosphatase and others. Positive phage are identified and purified. These phage then are tested for specificity of binding to sera from a pre-determined number of different humans previously infected with the HGBV agent, using the same method. Ideally, the phage will encode a polypeptide that reacts with all or a majority of the sera, plasma or liver homogenates that are tested, and will not react with sera, plasma or liver homogenates from individuals who are determined to be "negative" according to the criteria set forth herein for the HGBV agent as well as hepatitis A, B, C, D and E. By following these procedures, a clone that encodes a polypeptide which is specifically recognized immunologically by sera, plasma or liver homogenates from non-A, non-B, non-C, non-D and non-E-identified patients can be isolated.

The present invention will now be described by way of examples, which are meant to illustrate, but not to limit, the spirit and scope of the invention.

EXAMPLES

The examples provided herein describe in detail methods which led to the discovery of the HGBV group of viruses. The examples are provided in chronological order so that the discovery of the HGBV-A, HGBV-B and HGBV-C viruses of the HGBV group can be followed. Generally, transmissibility and infectivity studies were initially performed; these studies and subsequent ones described herein led to evidence for the existence of two HCV-like viruses in HGBV: GB-A and GB-B. Subsequent experiments also detailed herein utilizing degenerative primers led to the discovery of HGBV-C. The prevalence of this group of viruses in humans as evidenced by serological studies, the viral characterization of this group of viruses, the relatedness of HGBV to other viruses in its proposed genus and the interrelatedness of HGBV-A, HGBV-B and HGBV-C also is taught.

Example 1

Transmissibility of HGBV

A. Experimental Protocol

Sixteen tamarins (*Saguinus labiatus*) were secured through LEMSIP (Laboratory for Experimental Medicine and Surgery in Primates, Tuxedo, N.Y.) for the transmissibility and infectivity studies. All animals were maintained and monitored at LEMSIP according to protocols approved by LEMSIP. (Note: one animal died of natural causes and one ailing animal was euthanized prior to the initiation of infectivity studies). Baseline serum liver enzyme values were established for serum liver enzymes alanine transaminase (ALT), gamma-glutamyltransferase (GGT) and isocitric dehydrogenase (ICD) for two to three months on serum specimens obtained weekly or bi-weekly. A minimum of eight serum liver enzyme values were obtained for each animal prior to inoculation. Cutoff values (CO) were determined for each animal, based on the mean liver enzyme value plus 3.75 times the standard deviation. Liver enzyme values above the cutoff value were interpreted as abnormal and suggestive of liver damage. Several tamarins were inoculated as described hereinbelow and monitored for changes in ALT, GGT and ICD serum levels. At specified times thereafter during the monitoring process, certain animals were sacrified in order to obtain serum and tissues for further studies.

B. Inoculation of Animals (Initial Study)

A pool of known infectious tamarin GB serum (passage 11, designated as H205 GB pass 11) was prepared from serum collected during the early acute phase (19–24 days post inoculation) of hepatitis from nine tamarins inoculated with the HGBV. This pool had been previously described and studied in an effort to determine the etiological agent involved. J. L. Dienstag et al., *Nature* 264 supra; E. Tabor et al., *J. Med. Virol.* 5, supra. Aliquots of this pool were maintained at Abbott Laboratories (North Chicago, Ill. 60064) under liquid nitrogen storage conditions until utilized in this study. Other aliqouts of HGBV are available from the American Type Culture Collection (A.T.C.C.), 12301 Parklawn Drive, Rockville, Md. 20852, under A.T.C.C. Deposit.No. VR-806.

On day one, four tamarins of the initial group of remaining 14 tamarins, identified as T-1053, T-1048, T-1057 and T-1061, were inoculated intravenously with 0.25 ml of pool H205, passage 11, previously diluted 1:50. These animals were monitored weekly for changes in the liver enzymes ALT, GGT and ICD. TABLE 2 presents the pre- and post-inoculation liver enzyme data on these four tamarins (T-1053, T-1048, T-1057 and T-1061); FIGS. 1–4 present the pre- and post-inoculation ALT and ICD levels of these four tamarins. As the data demonstrate, significant rises in ALT, GGT and ICD above the CO were obtained in the four tamarins inoculated with the 1:50 dilution of pool H205.

On the same day (day one), one tamarin (T-1047) was inoculated intravenously with 0.25 ml of pooled normal tamarin serum and used as a negative control, and another tamarin (T-1042) was inoculated intraveneously with 0.25 ml of pooled normal human serum and served as an additional negative control. FIGS. 5–6 and TABLE 3 present the pre- and post-inoculation ALT and ICD levels of the two control tamarins (T-1047 and T-1042). As the data demonstrate, no rise in ALT or ICD was documented post-inoculation for the two control tamarins for a period of eight weeks.

On the same day (day one), one tamarin (T-1044) was inoculated intravenously with 0.2 ml of convalescent sera obtained from the surgeon (original GB source) approximately three weeks following the onset of acute hepatitis. This specimen had been stored at −20° C. F. Deinhardt et al., *J. Exper. Med.* 125:673–688 (1967). Another tamarin (T-1034) was inoculated with 0.1 ml of this convalescent sera. As FIGS. 7–8 and TABLE 4 demonstrate, no rise in serum liver enzymes was observed in these tamarins for a period of eleven weeks post inoculation. Thus, these data demonstrate that infective HGBV was not detectable in the convalescent sera obtained from the original patient and stored at −20° C., which could indicate that the individual had recovered from infection and that the virus had been cleared from the patient's serum or that the viral titer had been reduced to non-detectable levels upon storage at −20° C.

C. Further Studies

Tamarin T-1053 showed a significant rise in serum liver enzymes one week post-inoculation, and was retested for liver enzymes on day 11 post-inoculation. At day 12 it was determined that significant elevations in serum liver enzymes were present, and the animal was sacrificed on that day. Plasma, liver and spleen tissue samples were obtained for further studies. The plasma from T-1053 served as the source for the RDA procedure discussed in Example 3 below; the liver tissue was utilized in Example 8 below.

Tamarins T-1048, T-1057 and T-1061 were monitored for serum liver enzyme values; all were observed to exhibit elevated serum liver enzyme levels within two weeks following inoculation; these elevated values were noted for six or more weeks post inoculation. All three tamarins were observed to have decreasing serum liver enzyme levels below the CO by 84 days post inoculation. On day 97 post inoculation, these three tamarins (T-1048, T-1057 and T-1061) were re-challenged with 0.10 ml of neat plasma obtained from tamarin T-1053 (shown to be infectious, see Example 2) to determine whether hepatitis as documented by elevations in serum liver enzymes could be re-induced. The data are presented in TABLE 2 and FIGS. 1, 3 and 4. As the data indicates, serum liver enzyme levels of two tamarins (T-1057 and T-1061) remained below the CO for three weeks post reinoculation. One tamarin (T-1048) exhibited mild elevations in serum liver enzyme levels two weeks immediately post-reinoculation. It was hypothesized that the mild elevations in T-1048 were attributable to either reinfection of liver tissue by HGBV or incomplete recovery from the initial inoculation with H205.

Example 2

Infectivity Studies

A. Experimental Protocol

Baseline readings on four tamarins were obtained as described in Example 1(A). Briefly, baseline serum liver enzymes (ALT, GGT and ICD) were established for each animal prior to inoculation. Cutoff values (CO) were determined for each animal, based on the mean liver enzyme value plus 3.75 times the standard deviation. Liver enzyme values above the cutoff were interpreted as abnormal and suggestive of liver damage.

B. Inoculation of Tamarins

The plasma from Tamarin T-1053, sacrificed at day 12 post inoculation (see Example 1[C]), was used as the inoculum for further studies. On day one, one tamarin (T-1055) was inoculated intravenously with 0.25 ml of neat T-1053 plasma. On the same day, two tamarins (T-1038 and T-1051) were inoculated intravenously with 0.25 ml of T-1053 plasma which had been serially diluted to either $10^{-4}$ (T-1038) or $10^{-5}$ (T-1051) in pooled normal tamarin plasma. On the same day, tamarin T-1049 was inoculated intravenously with 0.25 ml of plasma T-1053 which had been filtered through a series of filters of decreasing pore size (0.8 $\mu$m, 0.45 $\mu$m, 0.22 $\mu$m and 0.10 $\mu$m) and diluted at $10^{-4}$ in pooled normal tamarin plasma.

Figure 9:
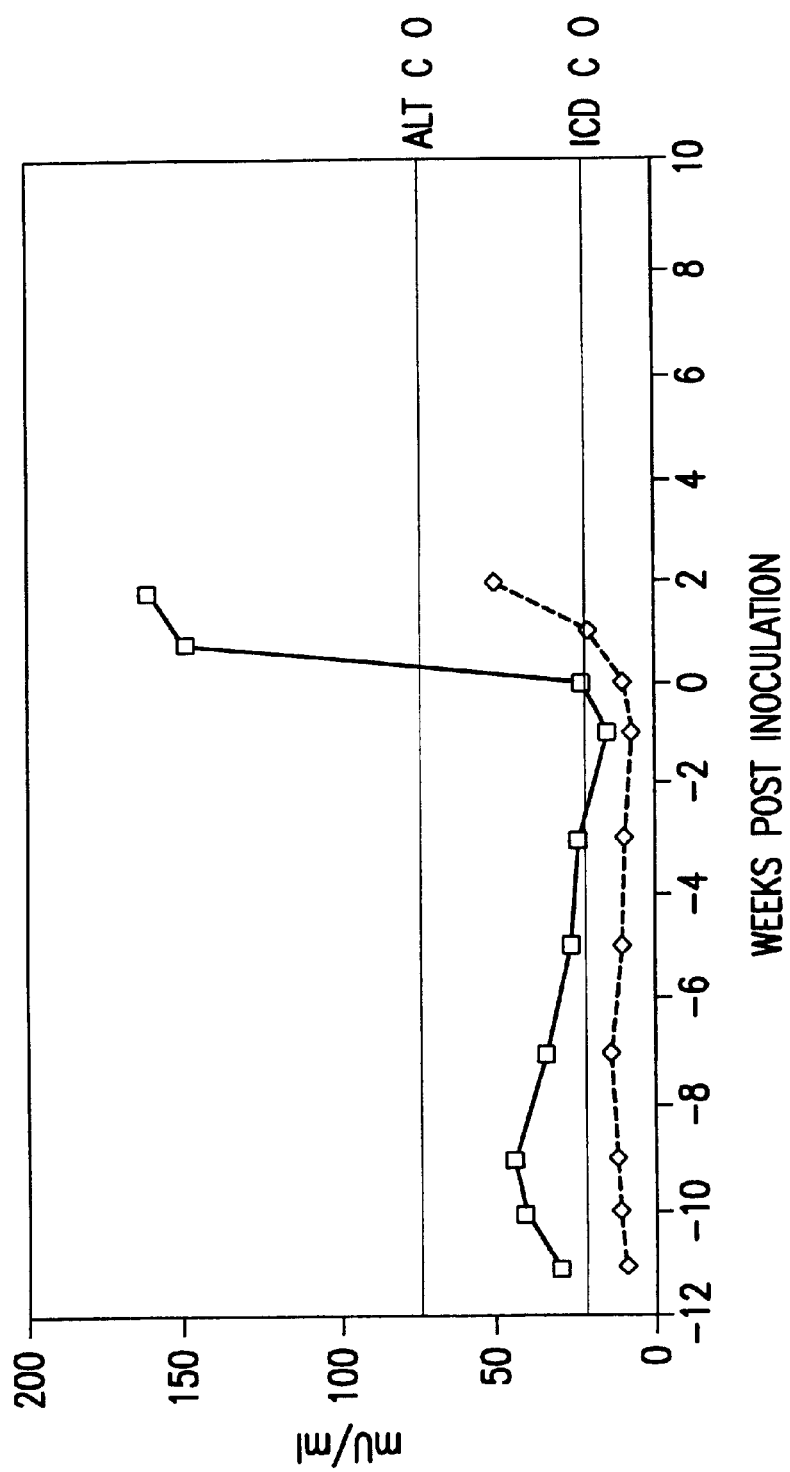
Figure 10:
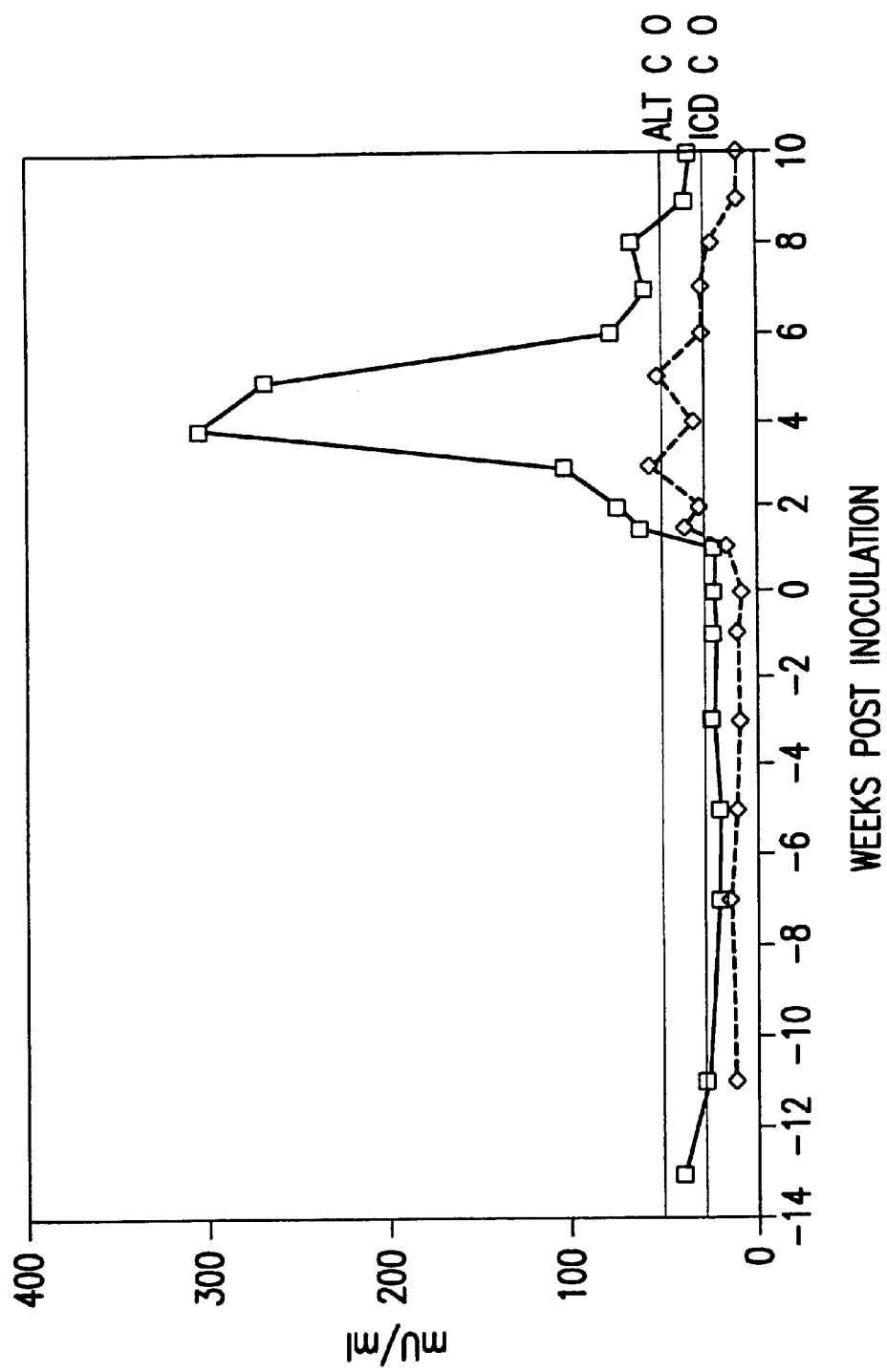
Figure 11:
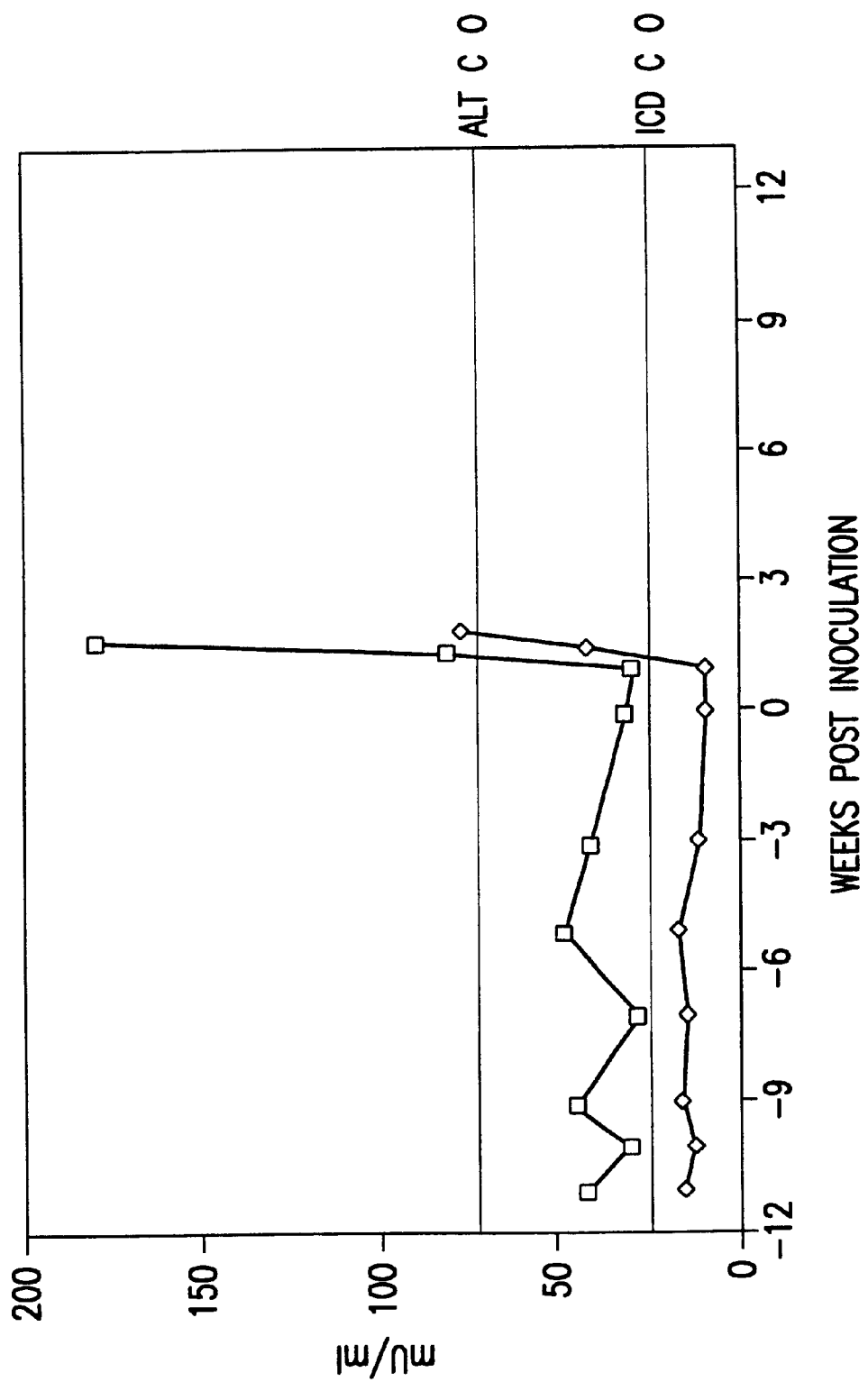
Figure 12:
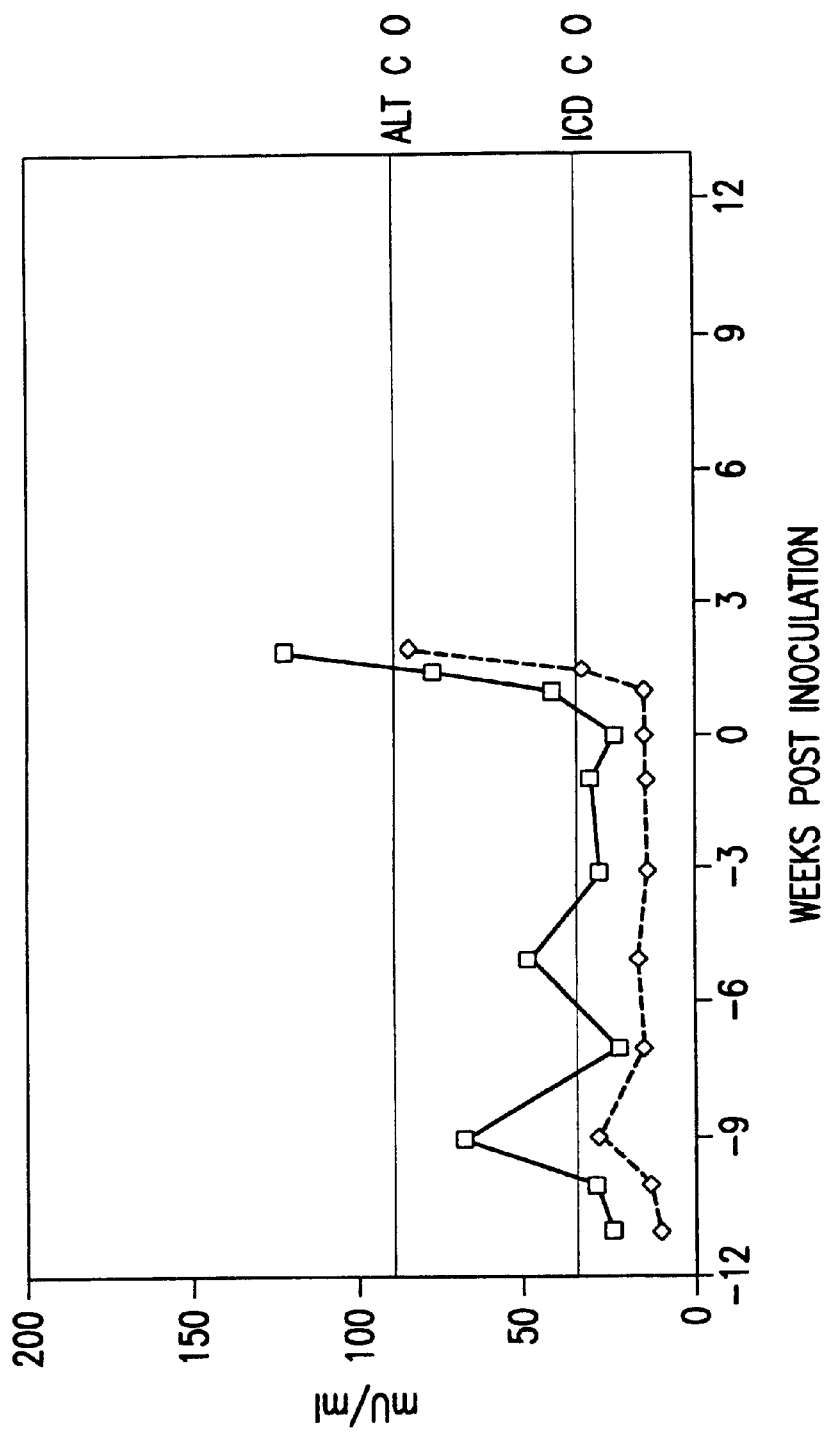

All tamarins (T-1055, T-1038, T-1051 and T-1049) were monitored weekly as described in Example 1 for changes in serum liver enzymes ALT, GGT and ICD. TABLE 5 presents the pre- and post-inoculation liver enzyme data on these four tamarins. FIG. 9 presents the pre- and post-inoculation ALT and ICD values T-1055. Referring to FIG. 9, it can be seen that elevations above the CO in serum liver enzymes ALT and ICD occurred. This tamarin was sacrificed on day 12 post-inoculation. FIGS. 10 and 11 present the pre- and post-inoculation serum levels of ALT and ICD for tamarins T-1051 and T-1038, respectively. Referring to FIGS. 10 and 11, it can be seen that elevations in serum liver enzymes ALT and ICD occured in both animals by 11 days post-inoculation. T-1038 was sacrificed on day 14 post inoculation. TABLE 5 and FIG. 12 present the data obtained on T-1049. As can be seen from TABLE 5 and FIG. 12, elevations in serum liver enzymes above the CO were observed in T-1049 within 11 days post-inoculation.

The filtration study conducted on T-1049 indicates that HGBV can pass through a 0.10 $\mu$m filter, thereby suggesting that HGBV is likely to be viral in nature, and less than 0.1 $\mu$m in diameter. In addition, the infectivity titration experiment conducted on T-1038 demonstrates that the T-1053 serum contains at least $4 \times 10^5$ tamarin infectious doses per ml.

In order to show the transmissibility of a single HGBV agent, tamarin T-1044 was inoculated with 0.25 ml of an inoculum consisting of T-1057 serum that had been obtained 7 days after the H205 inoculation and diluted 1:500 in normal tamarin serum. Mild elevations in ALT levels above the cutoff were observed from days 14–63 PI (that it, elevations in the range of 82 to 106).

Tamarins T-1047 and T-1056 were subsequently inoculated with 0.25 ml of T-1044 serum obtained 14 days PI and diluted 1:2 in normal tamarin serum. Elevations in ALT levels above the cutoff were first observed in T-1047 and T-1056 at 42 days PI and returned to normal levels at days 64 and 91 PI, respectively. Tamarin T-1058 was inoculated with 0.25 ml of neat T-1057 serum obtained 22 days after the challenge with T-1053 serum. Elevations in ALT levels have not been observed for 112 days PI.

Example 3

Representational Difference Analysis (Subtractive Hybridization)

A. Generation of Double-stranded DNA for Amplicons

Using the procedure described herein in Materials and Methods above and referring to FIG. 13, tester amplicon was prepared from total nucleic acid obtained from tamarin T-1053 infectious plasma on day 12 post inoculation with H205 serum (see Examples 1C and 2B). Driver amplicon was prepared from Tamarin T-1053 pre-inoculation plasma pooled from days -17 to -30 (see Example 1A). Briefly, both plasmas were filtered through a 0.1 $\mu$m filter as described in Example 2B. Next, 50 $\mu$l of each filtered plasma was extracted using a commercially available kit [United States Biochemical (USB), Cleveland, Ohio, cat. #73750] and 10 $\mu$g yeast tRNA as a carrier. This nucleic acid was subjected to random primed reverse transcription followed by random primed DNA synthesis using commercially available kits. Briefly, an 80 $\mu$l reverse transcription reaction was performed using Perkin Elmer's (Norwalk, Conn.) RNA PCR kit (cat. # N808-0017) as directed by the manufacturer using random hexamers and incubating for 10 minutes at 20° C. followed by 2 hours incubation at 42° C. The reactions then were terminated and cDNA/RNA duplexes denatured by incubation at 99° C. for 2 minutes. The reactions were supplemented with 10 $\mu$l 10×RP buffer [100 mM NaCl, 420 mM Tris (pH 8.0), 50 mM DTT, 100 $\mu$g/ml BSA], 250 pmoles random hexamers and 13 units Sequenase® version 2.0 polymerase (USB, cat. #70775) in a total volume of 20 $\mu$l. The reactions were incubated at 20° C. for 10 minutes followed by 37° C. for 2 hours. After phenol:chloroform extraction and ethanol precipitation, the double stranded DNA products of these reactions were digested with 4 units of restriction endonuclease Sau3A I (New England Biolabs [NEB], cat. #169L) in 30 $\mu$l reaction volumes for 30 minutes, as directed by the supplier.

B. Generation of Amplicons

Sau3AI-digested DNA was extracted and precipitated as described above. The entire Sau3AI-digested product was annealed to 465 pmoles R Bgl 24 (SEQUENCE I.D. NO. 1) and 465 pmoles R Bgl 12 (SEQUENCE I.D. NO. 2) in a 30 $\mu$l reaction volume buffered with 1×T4 DNA ligase buffer (NEB) by placing the reaction in a 50–55° C. dry heat block which was then incubated at 4° C. for 1 hour. The annealed product was ligated by adding 400 units T4 DNA ligase (NEB, cat. # 202S). After incubation for 14 hours at 16° C., a small scale PCR was performed. Briefly, 10 $\mu$l of the ligation reaction was added to 60 $\mu$l $H_2O$, 20 $\mu$l 5×PCR buffer (335 mM Tris, pH 8.8, 80 mM $[NH_4]_2SO_4$, 20 mM $MgCl_2$, 0.5 $\mu$g/ml bovine serum albumin, and 50 mM 2-mercaptoethanol), 8 $\mu$l of 4 mM dNTP stock, 2 $\mu$l (124 pmoles) R Bgl 24 (SEQUENCE I.D. NO. 3) and 3.75 units of AmpliTaq® DNA polymerase (Perkin Elmer, cat. # N808-1012). The PCR amplification was performed in a GeneAmp® 9600 thermocycler (Perkin Elmer). Samples were incubated for 5 min. at 72° C. to fill-in the 5'-protruding ends of the ligated adaptors. The samples were amplified for 25 to 30 cycles (1 min. at 95° C. and 3 min. at 72° C.) followed by extension of 72° C. for 10 min. After agarose gel confirmation of successful amplicon generation (ie. a smear of PCR products ranging from approximately 100 bp to over 1500 bp), a large scale amplification of tester and driver amplicons was performed. Forty 100 $\mu$l PCRs and eight 100 $\mu$l PCRs were set up as described above for the prepartion of driver and tester amplicons, respectively. Two $\mu$l from the small scale PCR product per 100 $\mu$l reaction served as the template for the large scale amplicon generation. Thermocycling was performed as described above for an additional 15 to 20 cycles of amplification. The PCR reactions for both driver and tester DNA were then phenol/chloroform extracted twice, isopropanol precipitated, washed with 70% ethanol and digested with Sau3AI to cleave away the adaptors. The tester amplicon was further purified on a low melting point agarose gel. Briefly, 10 μg of tester amplicon DNA was run on a 2% SeaPlaque® gel (FMC Bioproducts, Rockland, Me.). Fragments of 150–1500 base pairs were excised from the gel, the gel slice was melted at 72° C. for 20 minutes with 3 ml H$_2$O, 400 μl 0.5 M MOPS and 400 μl NaCl. DNA was recovered from the melted gel slice using a Qiagen-tip 20 (Qiagen, Inc., Chatsworth, Calif.) as directed by the manufacturer.

C. Hybridization and Selective Amplification of Amplicons

Approximately 2 μg of purified tester DNA amplicon was ligated to N Bgl 24 (SEQUENCE I.D. NO.3) and N Bgl 12 (SEQUENCE I.D. NO. 4) as described above. For the first subtractive hybridization, tester amplicon ligated to the N Bgl primer set (0.5 μg) and driver amplicon (20 μg) were mixed, phenol/chloroform extracted and ethanol precipitated. The DNA was resuspended in 4 μl of EE×3 buffer (30 mM EPPS, pH 8.0 at 20° C. [Sigma, St. Loius,Mo.], 3 mM EDTA) and overlaid with 35 μl of mineral oil. Following heat denaturation (3 min at 99° C.), 1 μg of 5 M NaCl was added to the denatured DNA and the DNA was allowed to hybridize at 67° C. for 20 hours. The aqueous phase was removed to a new tube and 8 μl of tRNA (5 mg/ml) was added to the sample followed by 390 μl TE (10 mM Tris, pH 8.0 and 1 mM EDTA). Eighty μl of the hybridized DNA solution was added to 480 μl H$_2$O, 160 μl 5×PCR buffer (above), 64 μl 4 mM dNTPs and 6 μl (30 units) AmpliTaq® polymerase. This solution was incubated at 72° C. for 5 min. to fill in the 5' overhangs created by the ligated N Bgl 24 primer. N Bgl 24 (SEQUENCE I.D. NO. 3, 1.24 nmoles in 20 μl H$_2$O) was added, the reaction was aliquoted (100 μl/tube) and subjected to 10 cycles of amplification as described above. The reaction was pooled, phenol/chloroform extracted twice, isopropanol precipitated, washed with 70% ethanol and resuspended in 40 μl H$_2$O. Single-stranded DNA was removed by mung bean nuclease (MBN). Briefly, 20 μl amplified DNA was digested with 20 units MBN (NEB) in a 40 μl reaction as described by the supplier. One hundred and sixty μl 50 mM Tris, pH 8.8 was added to the MBN digest. The enzyme was heat inactivated at 99° C. for 5 min. Eighty μl of the MBN-digested DNA was PCR amplified as described above for an additional 15 cycles. Again, the reaction was pooled, phenol/chloroform extracted twice, isopropanol precipitated, washed with 70% ethanol and resuspended in H$_2$O. The amplified DNA (3 to 5 μg) was then digested with Sau3A I, extracted and precipitated as described above. The final DNA pellet was resuspended in 100 μl TE.

D. Subsequent Hybridization/amplification Steps

One hundred ng of the DNA from the previous hybridization/selective amplification was ligated to the J Bgl primer set (SEQUENCE I.D. NO. 5 and SEQUENCE I.D. NO. 6) as described previously. This DNA (50 ng) was mixed with 20 μg of driver amplicon and the hybridization and amplificiation procedures were repeated as described above except that the extention temperature during the thremocycling was 70° C. and not 72° C. as for the N Bgl primer set (SEQUENCE I.D. NO. 3 and SEQUENCE I.D. NO. 4) and the final amplification step (after MBN digestion) was for 25 cycles. One hundred ng of the second hybridization-amplification product was then ligated to the N Bgl primer set (SEQUENCE I.D. NO. 3 and SEQUENCE I.D. NO. 4), and 200 pg of this material together with 20 μg of driver amplicon was taken for the third round of hybridization/amplification as described above with the final amplification for 25 cycles.

Figure 14:
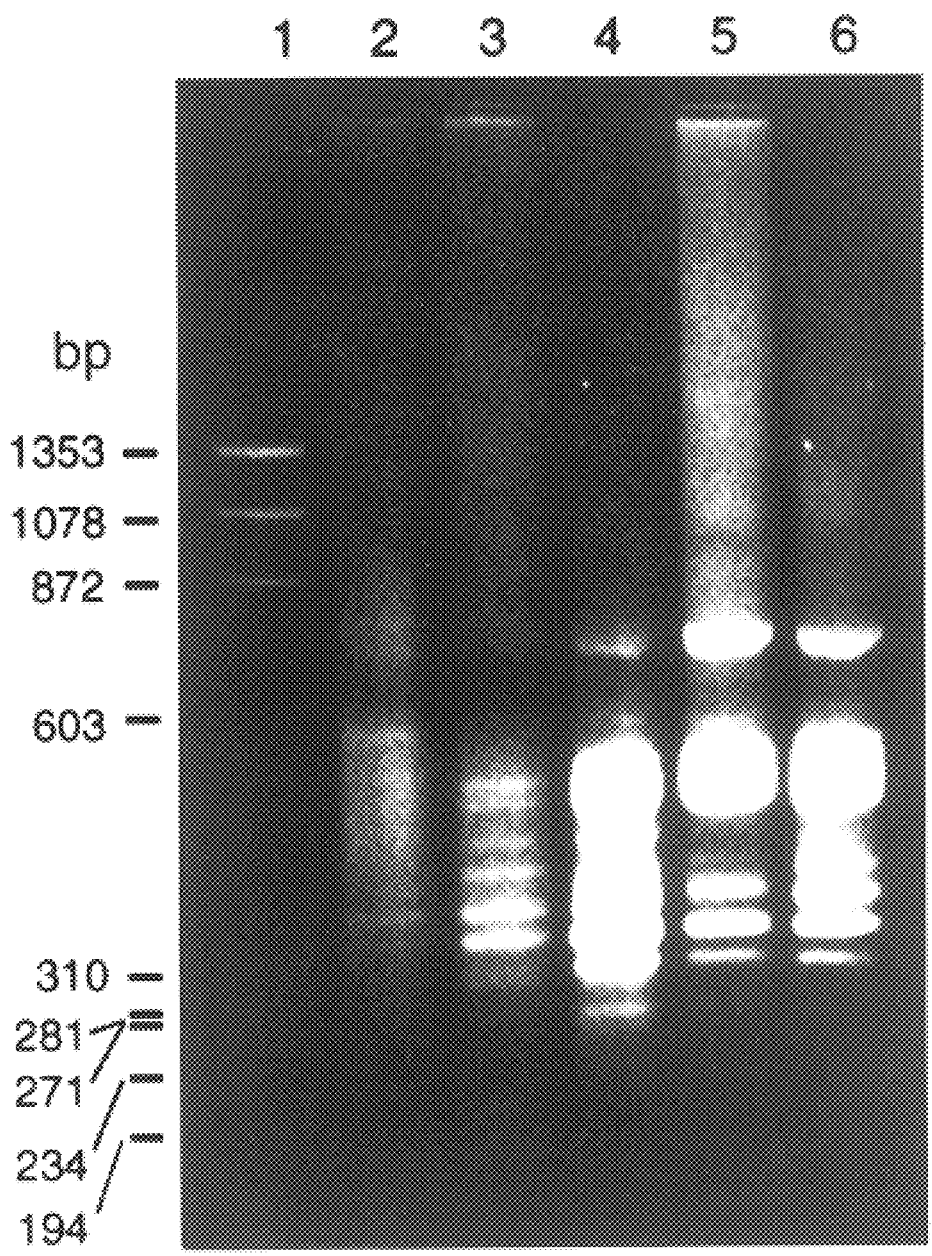
FIG. 14 shows an ethidium bromide stained 2.0% agarose gel of the products from the representational difference analysis (RDA) performed on pre-inoculation and acute phase HGBV-infectedtamarin plasma FIGS. 15A and B show an autoradiogram from a Southern blot of genomic DNA, amplicon DNA and products from the first three rounds of subtraction/hybridization.

A 2% agarose gel of the products from the representational difference analysis (RDA) performed on pre-HGBV inoculated and acute phase T-1053 plasma is shown in FIG. 14. Referring to FIG. 14, Lane 1 contains 150 ng of HaeIII digested Phi-X174 DNA marker (NEB) with the appropriate size (in bp) of the DNA fragments. The complexity of the driver amplicon (lane 2) and the tester amplicon (lane 3) is evidenced by the smear of DNA products seen in these samples. This complexity drops dramatically as the tester sequences are subjected to one (lane 4), two (lane 5) or three (lane 6) rounds of hybridization/selective amplification.

E. Cloning of the Difference Products

The difference products were cloned into the BamHI site of pBluescript II KS+ (Stratagene, La Jolla, Calif., cat. # 212207), as follows. Briefly, 0.5 μg pBluescript II was digested with BamHI (10 units, NEB) and 5' dephosphorylated with calf intestinal phosphatase (10 units, NEB) as directed by the supplier. The plasmid was phenol:chloroform extracted, ethanol precipitated, washed with 70% ethanol and resuspended in 10 μl H$_2$O (final concentration approximately 50 ng pBluescript II per μl). The four largest bands from the second hybridization/amplification products were excised from a 2% low melting point agarose gel as described above. Four μl of the melted (72° C., 5 min.) gel slices were ligated to 50 ng of the BamHI-cut, dephosphorylated pBluescript II in a 50 μl reaction using the Takara DNA ligation kit (Takara Biochemical, Berkeley, Calif.). After incubating at 16° C. for 3.5 hours, 8 μl of the ligation reactions were used to transform E. coli competent XL-1 Blue cells (Stratagene) as directed by the supplier. The transformation mixtures were plated on LB plates supplemented with ampicilin (150 μg/ml) and incubated overnight at 37° C. The resulting colonies were grown up in liquid culture and miniprep plasmid DNA was analyzed as described in the art to confirm the existence of cloned product.

In addition to the cloning of the four largest products from the second hybridization/amplification step, the entire population of products from the third hybridization/amplification step was cloned into pBluescript II. Briefly, 50 ng pBluescript II vector (prepared as above) was ligated to 10 ng of the third hybridization/amplification products in a 50 μl reaction as described above. After incubation at 16° C. for 2 hours, 10 μl ligation product was used to transform E. coli competent XL-1 Blue cells as before. Sixty colonies from the resultant transformation were grown up, and miniprep DNA was prepared and analyzed as described and known in the art. Restriction endonuclease digestion and dot blot hybridization experiments were used to identify unique clones.

Example 4

Immunoisolation of a cDNA Clone Encoding an Antigenic Region of the HGBV Genome

A. Preparation of Concentrated Virus as a Source of Cloning Material

The following isolation scheme was employed to isolate the HGBV genome in addition to the procedures exemplified in Example 3. Three tamarins (T-1055, T-1038 and T-1049) were inoculated with serum prepared from tamarin T-1053 as described in Example 2. Referring to TABLE 5, elevated liver enzyme values were noted in all 3 tamarins by day 11 PI. Tamarin T-1055 was sacrificed on day 12 PI and tamarins T-1038 and T-1049 were sacrificed on day 14 PI. Approximately 3–4 ml of serum from each of these three tamarins were pooled, providing a total volume of approximately 11.3 ml. The pooled serum was clarified by centrifugation at 10,000×g for 15 min at 15° C. It was then passed successively through 0.8, 0.45, 0.2, and 0.1 μm syringe filters. This filtered material was then concentrated by centrifugation through a 0.3 ml CsCl cushion (density 1.6 g/ml, in 10 mM Tris, 150 mM NaCl, 1 mM EDTA, pH 8.0) in a SW41-Ti rotor at 41,000 rpm at 4° C. for 68 min. The CsCl layer, approximately 0.6 ml, was removed following centrifugation and stored in three 0.2 ml aliquots at −70° C.

Tamarin T-1034 was subsequently inoculated with 0.25 ml of a $10^{-6}$ dilution of this pelleted material (prepared in normal tamarin serum). Elevated ALT liver enzyme values were first noted in T-1034 at 2 weeks PI, and remained elevated for the next 7 weeks, finally normalizing by week 10 PI (see FIG. 30, Example 14). This experiment demonstrated the infectivity of the material concentrated from the pooled tamarin sera. Since this material was shown to be of a relatively high titer, this concentrated source of virus was used as the source of nucleic acid for the preparation of a cDNA library, as described below.

B. cDNA Library Construction

An aliquot (0.2 ml) of the concentrated virus (described above) was extracted for RNA using a commercially available RNA extraction kit (Stratagene, La Jolla, Calif.) as instructed by the supplier. The sample was divided into four equal aliquots prior to the final precipitation step, and then precipitated in the presence of 5 μg/ml yeast tRNA. Only one of these aliquots was used for cDNA synthesis; the others were stored at −80° C. Phosphorylated, blunt-ended, double-stranded cDNA was prepared from the RNA using a commercially available kit (Stratagene, La Jolla, Calif.) as directed by the manufacturer. A double-stranded linker/primer was then ligated to the cDNA ends (sense strand, SEQUENCE I.D. NO. 7; antisense strand, SEQUENCE I.D. NO. 8) in a 10 μl reaction volume using a T4 DNA ligase kit (Stratagene, La Jolla, Calif.) as directed by the manufacturer. This provided all cDNAs in the mixture with identical 5' and 3' ends containing Not I and Eco RI restriction enzyme recognition sites. G. Reyes and J. Kim, *Mol. Cell. Probes* 5:473–481 (1991); A. Akowitz and L. Manuelidis, *Gene* 81:295–306 (1989); and G. Inchauspe et al., in *Viral Hepatitis and Liver Disease*, F. B. Hollinger et al., Eds., pp. 382–387 (1991). The sense-strand oligonucleotide of the linker/primer was then used as a primer in a PCR reaction such that all cDNAs were amplified independent of their sequence. This procedure allowed for the amplification of rare cDNAs present within the total cDNA population to a level which allowed them to be efficiently cloned, thus producing a cDNA library that is representative of the sequences within the starting material.

PCR was performed on 1 μl aliquot of the above ligate in the presence of the sense-strand oligonucleotide primer (final concentration: 1 μM; reaction volume: 50μl) using the GeneAmp PCR kit (Perkin-Elmer) as directed by the manufacturer in a PE-9600 thermocycler. Thirty cycles of PCR were performed as follows: denaturation at 94° C. for 0.5 min, annealing at 55° C. for 0.5 min, and extension at 72° C. for 1.5 min. A 1 μl aliquot of the resulting products was then re-amplified as described above. The final PCR reaction products were then extracted once with an equal volume of phenol-chloroform (1:1, v/v) and once with an equal volume of chloroform, and then precipitated on dry ice for 10 min following the addition of sodium acetate (final concentration, 0.3 M) and 2.5 volumes of absolute ethanol. The resulting DNA pellet was resuspended in water and digested with the restriction enzyme Eco RI (New England Biolabs) as directed by the manufacturer. The digested cDNAs were then purified from the reaction mixture using a DNA binding resin (Prep-a-Gene, BioRad Laboratories) as directed by the manufacturer and eluted in 20 μl of distilled water.

The cDNAs (8 μl) were ligated to 3 μg lambda gt11 vector DNA arms (Stratagene, La Jolla, Calif.) in a reaction volume of 30 μl at 4° C. for 1–5 days. Eleven microliters of the ligate was packaged into phage heads using GigaPack III Gold packaging extract (Stratagene, La Jolla, Calif.) as directed by the manufacturer. The resulting library contained a total of approximately 1.73 million members (PFU) at a recombination frequency of 89.3% with an average insert size of approximately 350 base pairs.

C. Immunoscreening of the Recombinant GB cDNA Library

The antiserum used for immunoscreening of the cDNA library was obtained from tamarins that had demonstrated elevations in their serum liver enzyme levels following inoculation. Two separate pools of antisera were used for immunoscreening. The first pool contained serum from two animals (T-1048 and T-1051; see Example 1, TABLE 2, and Example 2, TABLE 5, respectively) while the second pool contained serum from a single animal (T-1034; see FIG. 30, Example 14). The specific sera used are shown in TABLE 6.

At the time that these samples were chosen for use in cDNA library immunoscreening, they had not been tested for their immunoreactivity with either the 1.4 or 1.7 recombinant CKS proteins (Example 13). Therefore, the results shown herein were obtained independent of any information regarding the presence or absence of HGBV antibodies against these recombinant proteins within the antiserum used.

TABLE 6

Tamarin Sera used for Immunoscreening of GB cDNA Library

| Tamarin 1048[a] | | Tamarin 1051[b] | | Tamarin 1034[c] | |
| --- | --- | --- | --- | --- | --- |
| Days Post-Inoculate | Volume in Pool | Days Post-Inoculate | Volume in Pool | Days Post-Inoculate | Volume in Pool |
| 63 | 0.2 ml | 63 | 0.2 ml | 42 | 0.1 ml |
| 77 | 0.2 ml | 69 | 0.1 ml | 49 | 0.1 ml |
| 91 | 0.2 ml | 91 | 0.2 ml | 63 | 0.1 ml |
| 97 | 0.2 ml | 98 | 0.2 ml | 70 | 0.1 ml |
| 126 | 2.0 ml | 105 | 0.2 ml | 77 | 0.08 ml |
| | | 109 | 5.3 ml | | |

[a]Total T-1048 pool volume is 2.8 ml.
[b]Total T-1051 pool volume is 6.4 ml. One ml of each pool was saved and the remainder of each was combined and used as the primary antiserum for immunoscreening.
[c]Total T-1034 pool volume is 0.48 ml; the entire pool was used for immunoscreening.

The procedure used for the immnunoisolation of recombinant phage was based upon the method described by Young and Davis with modifications as described below. R. A. Young and R. W. Davis, *PNAS* 80:1194–1198 (1983). Two immunoscreening experiments were performed, one utilizing antiserum pooled from T-1048 and T-1051 and the other utilizing antiserum from T-1034. In both cases, the primary antiserum was pre-adsorbed against *E. coli* extract prior to use in order reduce non-specific interactions of antibody with *E. coli* proteins. In the first experiment, 1.29 million recombinant phage were immunoscreened with the T-1048/T-1051 antiserum pool; in the second experiment 0.30 million recombinant phage were immunoscreened with T-1034 antiserum. The recombinant phage library was plated on a lawn of *E. coli* strain Y1090r- and grown at 37° C. for 3.5 hours. The plates were then overlayed with nylon filters that were saturated with IPTG (10 mM) and the plates incubated at 42° C. for 3.5 hours. The filters were then blocked in Tris-saline buffer containing 1% BSA, 1% gelatin, and 3% Tween-20 ("blocking buffer") for 1 hour at 22° C. The filters were then incubated in primary antiserum (1:100 dilution in blocking buffer) at 4° C. for 16 hours. Primary antiserum was then removed and saved for subsequent rounds of plaque purification, and the filters washed four times in Tris-saline containing 0.1% Tween 20. The filters were then incubated in blocking buffer containing 125-I-labeled (or alkaline-phosphatase conjugated) goat anti-human IgG (available from Jackson ImmunoResearch, West Grove, Pa.) for 60 min at 22° C., washed as described above, and then exposed to x-ray film (or subjected to color developed according to established procedures, as in J. Sambrook et al., *Molecular Cloning: A Laboratory Manual*, 2nd edition, Cold Spring Harbor Press, Cold Spring Harbor, N.Y., 1989). Five immunopositive phage (4-3B1, 48-1A1, 66-3A1, 70-3A1, 78-1C1) were isolated from this library and subsequently tested for specificity of binding to antisera from three infected tamarins (T-1048, T-1051, T-1034) using the method described above. These recombinants encoded polypeptides that reacted with convalescent sera, but not with pre-inoculation sera, from each of the three infected tamarins (data not shown).

In order to verify the specificity of the immunological reactivity of the polypeptide encoded by the recombinant phage, each cDNA was rescued from the lambda phage genome by PCR using primers located 5' (SEQUENCE I.D. NO. 9) and 3' (SEQUENCE I.D. NO. 10) to the Eco RI cloning site. The PCR products were then digested with Eco RI and subsequently ligated into the *E. coli* expression plasmid pJO201 as described in Example 13. Insertion of the cDNAs into the Eco RI site of pJO201 maintained the translational reading frame of this cDNA as present in the lambda phage clone. The subclones in the pJO201 expression vector were designated 4-3B1.1, 48-1A1.1, 66-3A1.49, 70-3A1.37, and 78-1C1.17. Immunoblot analysis (as in Example 13) of *E. coli* lysates prepared from cultures expressing these cDNAs with convalescent sera from tamarins T-1034, T-1048, and T-1051 (1:100 dilution) demonstrated specific immunologic reactivity with a protein of the size predicted for each CKS-fusion protein. (data not shown). The DNA sequence of each of the cDNAs was determined and it was found that these clones possessed nearly 100% sequence identity with that of HGBV-B virus (SEQUENCE I.D. NO. 11). The sequence of the 4-3B1.1 insert (SEQUENCE I.D. NOS. 12 and 13), although not determined in its entirety, those portions that have been sequenced exhibit 99.5% Sequence identity to a portion of the sequence within HGBV-B (SEQUENCE I.D. NO. 11) from base pairs 6834–7458. This region of the HGBV-B (SEQUENCE I.D. NO. 11) sequence showing identity with that of the sequence obtained from clone 4-3B1.1 was translated into the +1 reading frame and is presented in the sequence listing as SEQUENCE I.D. NO. 14. The sequence of the 48-1A1.1 insert (SEQUENCE I.D. NO. 15) exhibits 100% Sequence identity to a portion of the sequence from HGBV-B (SEQUENCE I.D. NO. 11, see Example 9) from base pairs 4523–4752. The DNA sequence corresponding to SEQUENCE I.D. NO. 15 was translated into the +1 reading frame and is presented in the sequence listing as SEQUENCE I.D. NO. 16. The sequence of the 66-3A1.49 insert (SEQUENCE I.D. NO. 17) exhibits essentially 100% sequence identity to that of clone 48-1A1.1 and thus no protein translation is shown in the sequence listing. The sequence of the 70-3A1.37 insert (SEQUENCE I.D. NO. 18) exhibits 100% sequence identity to a portion of the sequence from HGBV-B (SEQUENCE I.D. NO. 11) from base pairs 6450–6732 except for a three base-pair deletion corresponding to bases 6630–6632 of the HGBV-B sequence (SEQUENCE I.D. NO. 11). The DNA sequence corresponding to SEQUENCE I.D. NO. 18 was translated into the +2 reading frame and is presented in the sequence listing as SEQUENCE I.D. NO. 19. The sequence of the 78-1C1.17 insert (SEQUENCE I.D. NO. 20) exhibits 100% sequence identity to that of clone 70-3A1.37 and thus no protein translation is shown in the sequence listing. These data demonstrate that the cDNA clones isolated from the lambda gt11 cDNA library are derived from the genome of the HGBV agent and that it encodes polypeptides which are specifically recognized immunologically by sera from GB-infected tamarins. Clones 48-1A1.1("clone 48") 4-3B1.1, 66-3A1.49, 70-3A1.37, and 78-1C1.17 have been deposited at the American Type Culture Collection as provided hereinabove.

Example 5

DNA Sequence Analysis of HGBV Clones

Unique clones obtained in Example 3 were sequenced using the dideoxynucleotide chain termination technique (Sanger, et al., supra) in a kit form (Sequenase® version 2.0, USB). These sequences are non-overlapping and are presented in the Sequence Listing as clone 4 (SEQUENCE I.D. NO. 21), clone 2 (SEQUENCE I.D. NO. 22), clone 10 (SEQUENCE I.D. NO. 23), clone 11 (SEQUENCE I.D. NO. 24), clone 13 (SEQUENCE I.D. NO. 25), clone 16 (SEQUENCE I.D. NO. 26), clone 18 (SEQUENCE I.D. NO. 27), clone 23 (SEQUENCE I.D. NO. 28), clone 50 (SEQUENCE I.D. NO. 29) and clone 119 (SEQUENCE I.D. No. 30). Clones 4, 2, 10, 11, 13, 16, 18, 23, 50 and 119 have been deposited at the A.T.C.C. Clone 2 was accorded A.T.C.C. Deposit No. 69556; Clone 4 was accorded A.T.C.C. Deposit No. 69557; Clone 10 was accorded A.T.C.C. Deposit No. 69558; Clone 16 was accorded A.T.C.C. Deposit No.69559; Clone 18 was accorded A.T.C.C. Deposit No. 69560; Clone 23 was accorded A.T.C.C. Deposit No. 69561; and Clone 50 was accorded A.T.C.C. Deposit No. 69562; Clone 11 was accorded A.T.C.C. Deposit No. No. 69613; Clone 13 was accorded A.T.C.C. Deposit No. 69611; and Clone 119 was accorded A.T.C.C. Deposit No. 69612.

The sequences were searched against the GenBank database using the BLASTN algorithm (Altschul et al, *J. Mol. Biol.* 215:403–410 [1990]). None of these sequences were found in GenBank, indicating that these sequences have not been previously characterized in the literature. The DNA sequences were translated into the six possible reading frames and are presented in the sequence listing (SEQUENCE I.D. NO. 21 translates to SEQUENCE I.D. NOS.31–36, SEQUENCE I.D. NO. 22 translates to SEQUENCE I.D. NOS. 37–42, SEQUENCE I.D. NO. 23 translates to SEQUENCE I.D. NOS. 43–48, SEQUENCE I.D. NO. 26 translates to SEQUENCE I.D. NOS. 49–54, SEQUENCE I.D. NO. 27 translates to SEQUENCE I.D. NOS. 55–60, SEQUENCE I.D. NO. 28 translates to SEQUENCE I.D. NOS. 61–66, and SEQUENCE I.D. NO. 29 translates to SEQUENCE I.D. NOS. 67–72). SEQUENCE I.D. NO. 24 is contained within SEQUENCE I.D. NO. 73 (described in Example 9), which translates to SEQUENCE I.D. NOS. 74–79. SEQUENCE I.D. NOS. 25 and 30 are contained within SEQUENCE I.D. NO. 80 (described in Example 9), which translates to SEQUENCE I.D. NO. 81–86. The translated sequences were used to search the SWISS-PROT database using the BLASTX algorithm (Gish et al., *Nature Genetics* 3:266–272 [1993]). Again, none of these sequences were found in SWISS-PROT indicating that these sequences have not been previously characterized in the literature.

Homology searches conducted using the BLASTN, BLASTX and FASTdb algorithms demonstrate some, albeit low, sequence resemblence to hepatitis C virus (TABLE 7, below). Specifically, translations of clones 4 (SEQUENCE I.D. NO. 35), 10 (SEQUENCE I.D. NO. 44), 11 (residues 1–166 of GB-A, frame 3 [SEQUENCE I.D. NO. 76]), 16 (SEQUENCE I.D. NO. 50), 23 (SEQUENCE I.D. NO. 65), 50 (SEQUENCE I.D. NOS. 70 and 72) and 119 (residues 912–988 of GB-A, frame 3 [SEQUENCE I.D. NO. 83]), are between 24.1% and 45.1% homologous to various HCV isolates at the amino acid level. Of particular interest, translation of clone 10 (SEQUENCE I.D. NO. 44) showed limited homology to the putative RNA-dependent RNA polymerase of HCV. A comparison of the conserved amino acids present in the putative RNA-dependent RNA polymerase of other positive strand viruses (Jiang et al. *PNAS* 90:10539–10543 [1993]) with the putative amino acid translation of clone 10 (SEQUENCE I.D. NO. 44) revealed that conserved amino acid residues of other RNA-dependent RNA polymerases are also conserved in clone 10 (SEQUENCE I.D. NO. 44). This includes the canonical GDD (Gly-Asp-Asp) signature sequence of RNA-dependent RNA polymerases. Thus, clone 10 (SEQUENCE I.D. NO. 44) appears to encode a viral RNA-dependent RNA polymerase. Surprisingly, only clone 10 (SEQUENCE I.D. NO. 44) showed any sequence homology with HCV at the nucleotide level when the BLASTN algorithm was used. Clones 4 (SEQUENCE I.D. NO. 21), 16 (SEQUENCE I.D. NO. 26), 23 (SEQUENCE I.D. NO.28) and 50 (SEQUENCE I.D. NO. 29) and 119 (SEQUENCE ID. NO. 30) which have low HCV homology at the amino acid level, were not detected by BLASTN in searches of GenBank. In addition, clones 2 (SEQUENCE I.D. NOS. 37–42), 13 (SEQUENCE I.D. NO. 25 and 37–42) and 18 (SEQUENCE I.D. NOS. 27 and 55–60) showed no significant nucleotide or amino acid homology to HCV when searched against GenBank or SWISS-PROT as described hereinabove.

TABLE 7

HCV Homology of HGBV Cones

| Clone | Homology | | Strain[c] | Region[d] | Function[e] |
|---|---|---|---|---|---|
| | Nucleotide[a] | Amino Acid[b] | | | |
| 4 | none | 28/73 (38.4%) | HCVTW | NS4 | unknown |
| 10 | 134/307 (43.6%)[f] | 46/102 (45.1%) | HCVJ6 | NS5 | replicase |
| 11 | none | 40/166 (24.1%) | HCVJT | NS5 | replicase |
| 16 | none | 55/177 (31.1%) | HCVJ8 | NS2/3 | protease |
| 23 | none | 44/121 (36.4%) | HCVJA | NS3 | helicase |
| 50 | none | 29/112 (25.9%) | HCVH | NS4/5 | unknown |
| 119 | none | 27/77 (35.1%) | HCVTW | NS5 | replicase |

[a]Homology found to HCV when GB clones were searched against GenBank using the BLAST algorithm.
[b]Homology found to HCV when translated GB clone sequences were searched against SWISS-PROT using the FASTdb algorithm.
[c]Most homologous strain of HCV (SWISS-PROT designation)
[d,e]Region of homology and reputed function of clone compared with HCV according to Houghton et al., Hepatology 14(2):381–388 (1991).
[f]BLASTN detected a segment of clone 10 that was 64% homologous with HCV NS5 over 132 nucleotides. Alignment of the entire clone 10 sequences with the homologous nucleotide sequence of HCVJ6 shows 43.6% homology.

Example 6

Exogenicity of HGBV Clones

The HGBV clones were not detected in normal or HGBV-infected tamarin liver DNA, normal human lymphocyte DNA, yeast DNA or *E. coli* DNA. This was demonstrated for HGBV clones 2 (SEQUENCE I.D. NO. 22) and 16 (SEQUENCE I.D. NO. 26) by Southern blot analysis. In addition, all HGBV clones was analyzed by genomic PCR to confirm the exogenous origin of the HGBV sequences with respect to the tamarin, human, yeast and *E. coli* genomes. These data are consistent with the viral nature of the HGBV sequences described in Example 5.

A. Southern Blot Analysis

Tamarin liver nuclei were obtained from low speed pelleting of liver homogenates of HGBV-infected and normal tamarins (described hereinbelow). DNA was extracted from nuclei using a commercially available kit (USB cat. # 73750) as directed by the supplier. The tamarin DNA was treated with RNase during the extraction procedure. Human placental DNA (Clontech, Palo Alto, Calif.), yeast DNA (*Saccharomyces cerevisiae*, Clontech) and *E. coli* DNA (Sigma) were obtained from commercial sources.

Each DNA sample was digested with BamHI (NEB) according to the suppliers direction. Digested DNAs (10 $\mu$g) and RDA products (0.5 $\mu$g each from Example 3B) were electrophoresed on 1% agarose gels and capillary blotted to Hybond-N+ nylon membranes (Amersham, Arlington Heights, Ill.) as described in Sambrook et al. (pp. 9.34 ff). DNA was fixed to the membrane by alkali treatment as directed by the membrane supplier. Membranes were prehybridized in Rapid Hyb solution (Amersham) at 65° C. for 30 min.

Radiolabeled probes of the HGBV sequences were prepared by PCR. Briefly, 50 $\mu$l PCRs were set up using 1×PCR buffer II (Perkin Elmer), 2 mM $MgCl_2$, 20 $\mu$M dNTPs, 1 $\mu$M each of clone specific sense and antisense primers (for clone 2, SEQUENCE I.D. NOS. 87 and 88; for clone 4, SEQUENCE I.D. NOS. 89 and 90; for clone 10, SEQUENCE I.D. NOS. 91 and 92; for clone 16, SEQUENCE I.D. NOS. 93 and 94; for clone 18, SEQUENCE I.D. NOS. 95 and 96; for clone 23, SEQUENCE I.D. NOS. 97 and 98; and for clone 50, SEQUENCE I.D. NOS. 99 and 100), 1 ng HGBV clone plasmid (described in Example 3[E]), 60 $\mu$Ci $\alpha$-$^{32}$P-dATP (3000 Ci/mmol) and 1.25 units of AmpliTaq® polymerase (Perkin Elmer). The reactions were incubated at 94° C. for 30 sec., 55° C. for 30 sec., and 72° C. for 30 sec. for a total of 30 cycles of amplification followed by a final extension at 72° C. for 3 minutes. Unincorporated label was removed by Quick-Spin® G-50 spin columns (Boehringer Mannheim, Indianapolis, Ind.) as directed by the supplier. The probes were denatured (99° C., 2 min.) prior to addition to the pre-hybridized membranes.

Radiolabeled probes were added to the prehybridized membranes (2×10$^6$ dpm/ml) and filters were hybridized at 65° C. for 2.5 hours as directed by the Rapid Hyb® supplier. The hybridized membranes were washed under conditions of moderate stringency (1×SSC, 0.1% SDS at 65° C.) before being exposed to autoradiographic film for 72 hours at −80° C. with an intensifying screen. These conditions were designed to detect a single copy gene with a similar radiolabeled probe.

Figure 15A:
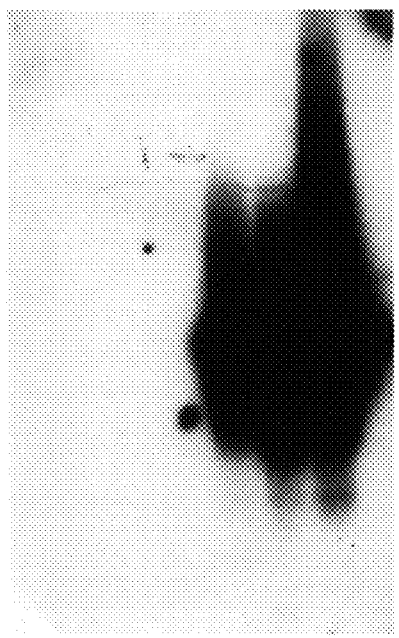
Figure 15B:
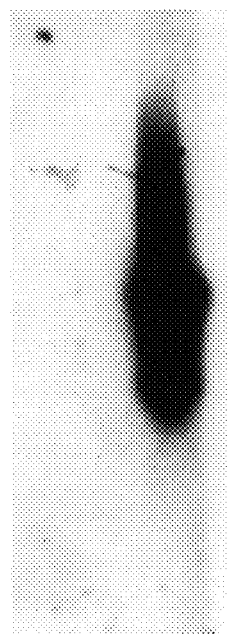
Figure 16A:
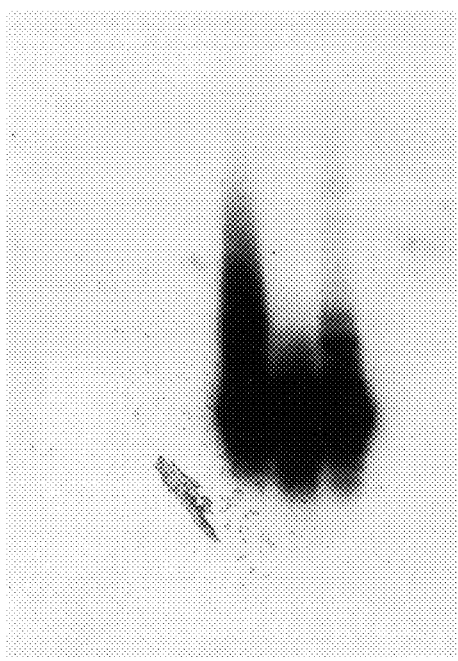
FIGS. 16A and B show the same autoradiogram as described in FIG. 15, except that an alternative radiolabeled probe is used.
Figure 16B:
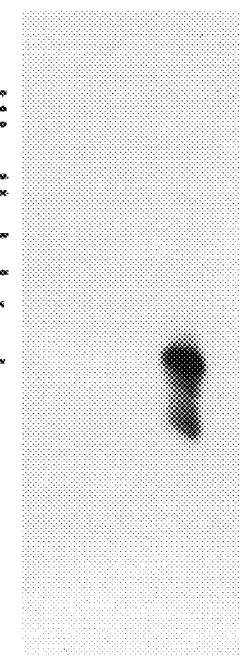

The results show that clone 2 (SEQUENCE I.D. NO. 22) and clone 16 (SEQUENCE I.D. NO. 26) sequences did not hybridize to DNA from normal or HGBV-infected tamarin liver (FIGS. 15 and 16, lanes 1B and 3B, respectively), human DNA (FIGS. 15 and 16, lane 1A), yeast DNA (FIGS. 15 and 16, lane 2A) or *E. coli* DNA (FIGS. 15 and 16, lane 3A). In addition, no hybridization was detected with the driver amplicon DNA (FIGS. 15 and 16, lanes 4A, derived from pre-HGBV-inoculated tamarin plasma as described in Example 2.B). In contrast, strong hybridization signals were seen with the tester amplicon (FIGS. 15 and 16, lane 6A, derived from infectious HGBV tamarin plasma using total nucleic acid extraction and reverse transcription steps as described in Example 2.B) and the products of the three rounds of subtraction/selective amplification (FIGS. 15 and 16, lanes 7A, 8A and 4B referring to the products from the first, second and third rounds of subtraction/selective amplification, respectively). These data demonstrate that HGBV clones 2 (SEQUENCE I.D. NO. 22) and 16 (SEQUENCE I.D. NO. 26) can be detected in nucleic acid sequences amplified from infectious sources; HGBV clones 2 (SEQUENCE I.D. NO. 22) and 16 (SEQUENCE I.D. NO. 26) are not derived from tamarin, human, yeast or E. coli genomic DNA sequences.

B. Genomic PCR Analysis

To further demonstrate the exogenicity of the HGBV sequences and support their viral origin, PCR was performed on genomic DNA from tamarin, human, yeast and E. coli. DNA from normal tamarin kidney and liver tissue was prepared as described by J. Sambrook et al., supra. Yeast, Rhesus monkey kidney and human placental DNAs were obtained from Clontech. E. coli DNA was obtained from Sigma.

PCR was performed using GeneAmp® reagents from Perkin-Elmer-Cetus essentially as directed by the supplier's instructions. Briefly, 300 ng of genomic DNA was used for each 100 μl reaction. PCR primers derived from HGBV cloned sequences (for clone 2, SEQUENCE I.D. NOS. 87 and 88; for clone 4, SEQUENCE I.D. NOS. 89 and 90; for clone 10, SEQUENCE I.D. NOS. 91 and 92; for clone 16, SEQUENCE I.D. NOS. 93 and 94; for clone 18, SEQUENCE I.D. NOS. 95 and 96; for clone 23, SEQUENCE I.D. NOS. 97 and 98; and for clone 50, SEQUENCE I.D. NOS. 99 and 100) were used at a final concentration of 0.5 μM. PCR was performed for 35 cycles (94° C., 1 min; 55° C., 1 min; 72° C., 1 min) followed by an extension cycle of 72° C. for 7 min. The PCR products were separated by agarose gel electrophoresis and visualized by UV irradiation after direct staining of the nucleic acid with ethidium bromide and/or hybridizaion to a radiolabelled probe after Southern blot transfer to a nitrocellulose filter. Probes were generated as described in Example 6A. Filters were prehybridized in Fast-Pair Hybridization Solution from Digene (Belstville, Md.) for 3–5 hours and then hybridized in Fast-Pair Hybridization Solution with 100–200 cpm/cm² at 42° C. for 15–25 hours. Filters were washed as described in G. G. Schlauder et al., J. Virol. Methods 37:189–200 (1992) and exposed to Kodak X-Omat-AR film for 15 to 72 hours at −70° C. with intensifying screens.

Figure 17:
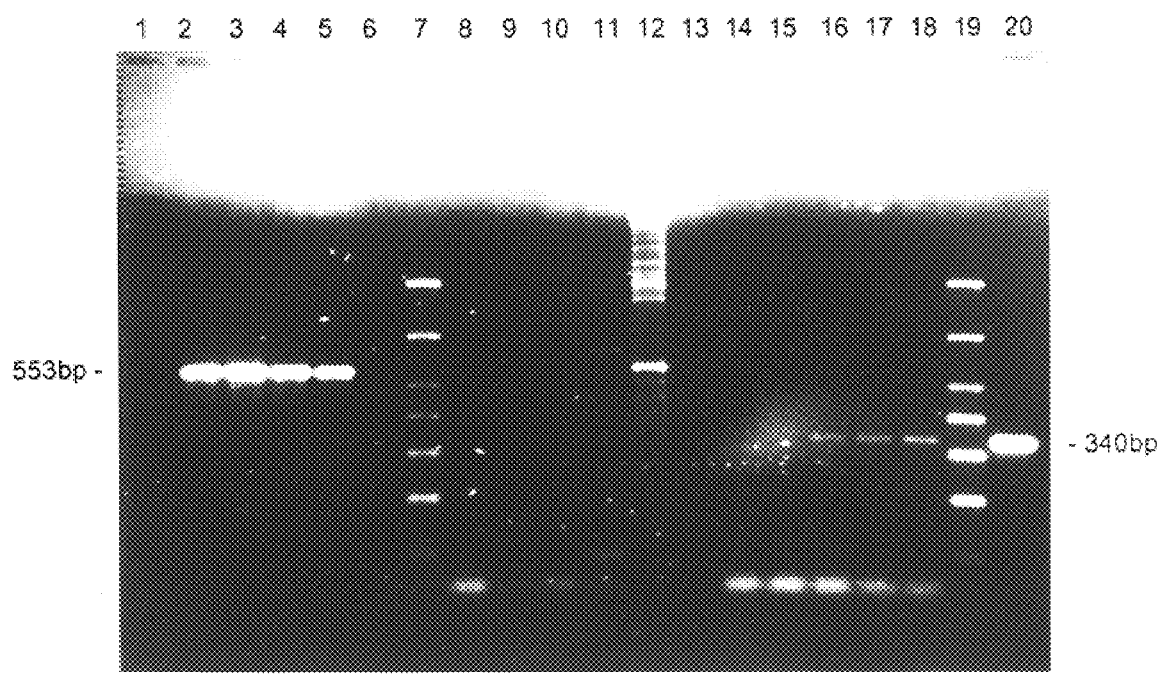
FIG. 17 shows an ethidium bromide stained 1.5% agarose gel of polymerase chain reaction (PCR) amplified product from genomic DNA.
Figure 18:
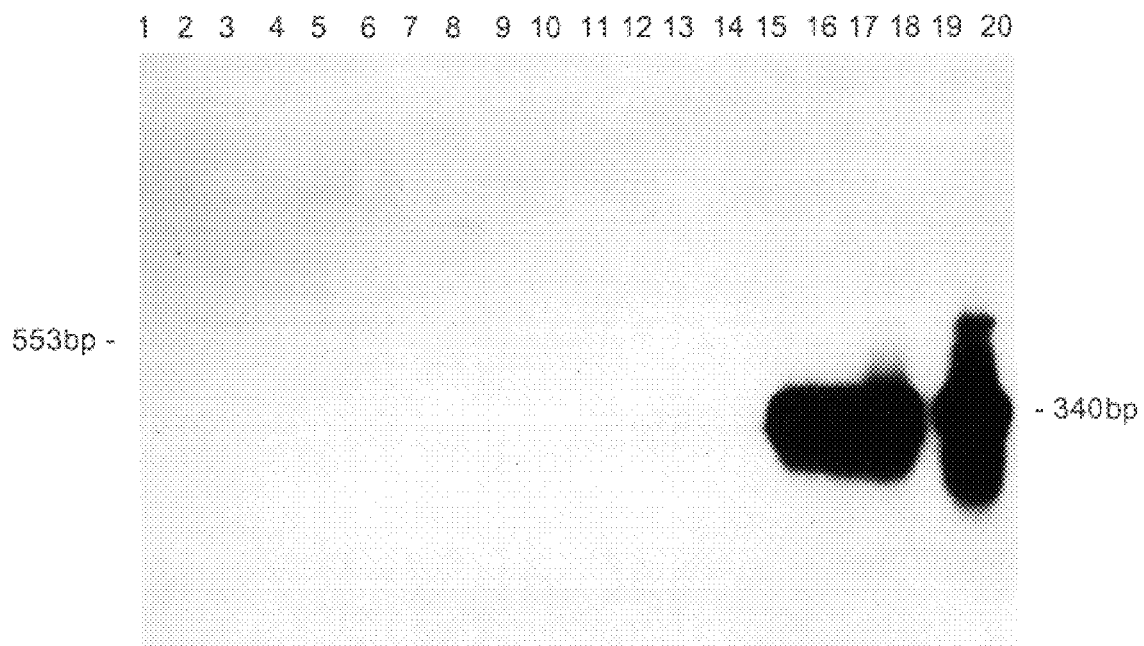
FIG. 18 shows an autoradiogram from a Southern blot of the 1.5% agarose gel in FIG. 17.

FIG. 17 shows an ethidium bromide stained 1.5% agarose gel. FIG. 18 shows an autoradiogram from a Southern blot from the same gel after hybridization to the radiolabeled probe from clone 16 (SEQUENCE I.D. NO. 26). Consistent with its exogenous nature, clone 16 (SEQUENCE I.D. NO. 26) sequences were not detected in tamarin (FIG. 17 and 18, lanes 9 and 10), Rhesus monkey (lane 11) or human genomic DNAs (lane 12) or in yeast or E. coli DNAs (data not shown) by genomic PCR analysis despite being able to detect clone 16 (SEQUENCE I.D. NO. 26) sequences that have been spiked into normal tamarin liver and kidney DNA at 0.05 genome equivalents (lanes 17 and 18). In addition, primers derived from the human dopamine D1 receptor gene, 1000–1019 base pairs (sense primer) and 1533–1552 base pairs (antisense primer) (GenBank accession number X55760, R. K. Sunahara. et al., Nature 347:80–83 [1990]) successfully amplified the dopamine D1 receptor DNA from the primate genomic DNAs (FIG. 17 lanes 2, 3, 4 and 5 corresponding to tamarin kidney, tamarin liver, rhesus monkey and human DNAs) demonstrating the utility of this method for detecting low copy number (i.e. single copy) sequences. Lanes 1 and 8 are H₂O contols for dopamine D1 receptor and clone 16 primers (SEQUENCE I.D. NOS. 93 and 94), respectively. Lane 6 contains 100 fg of clone 16 (SEQUENCE I.D. NO. 26) plasmid DNA amplified with the dopamine receptor primers. Lanes 14, 15, 16 and 20 contain 1, 3, 10, and 100 fg, respectively, of clone 16 (SEQUENCE I.D. NO. 26) plasmid DNA. Lanes 7 and 19 are markers. Similar results were obtained using PCR primers specific for clones 2, 4, 10, 18, 23 and 50 described above (data not shown). Clones 2 (SEQUENCE I.D. NO. 22), 4 (SEQUENCE I.D. NO. 21), 10 (SEQUENCE I.D. NO. 23), 18 (SEQUENCE I.D. NO. 27), 23 (SEQUENCE I.D. NO. 28) and 50 (SEQUENCE I.D. NO. 29) are inconclusive at this time. However, clones 4 (SEQUENCE I.D. NO. 21), 10 (SEQUENCE I.D. NO. 23), 18 (SEQUENCE I.D. NO. 27) and 50 (SEQUENCE I.D. NO. 29) sequences were not detected in tamarin, human, yeast and E. coli DNA, (Rhesus monkey was not tested) indicating that these sequences are exogenous to the genomic DNA sources tested and supporting the viral origin of these sequences.

Example 7

Presence of HGBV Sequences in Tamarin Sera

The presence of the HGBV clone sequences in pre-inoculation and acute phase T-1053 plasma was examined by PCR. Because the HGBV genome could be DNA or RNA, PCR and RT-PCR was performed. Specifically, total nucleic acids were extracted from plasma as described in Example 3(A). PCR was performed on the equivalent of 5 μl plasma nucleic acids as described in Example 6(B) and RT-PCR was performed using the GeneAmp® RNA PCR Kit from Perkin-Elmer-Cetus essentially according to the manufacturer's instructions using 1 μM concentration of primers (for clone 2, SEQUENCE I.D. NOS.87 and 88; for clone 4, SEQUENCE I.D. NOS. 89 and 90; for clone 10, SEQUENCE I.D. NOS. 91 and 92; for clone 16, SEQUENCE I.D. NOS. 93 and 94; for clone 18, SEQUENCE I.D. NOS. 95 and 96; for clone 23, SEQUENCE I.D. NOS. 97 and 98; and for clone 50, SEQUENCE I.D. NOS. 99 and 100) in the PCRs. cDNA synthesis was primed with random hexamers.

Ethidium bromide staining and hybridization of the PCR products demonstrated the presence of HGBV clone sequences 2 (SEQUENCE I.D. NO. 22), 4 (SEQUENCE I.D. NO. 21), 10 (SEQUENCE I.D. NO. 23), 16 (SEQUENCE I.D. NO. 26), 18 (SEQUENCE I.D. NO. 27), 23 (SEQUENCE I.D. NO. 28) and 50 (SEQUENCE I.D. NO. 29) in the acute phase T-1053 plasma and not the pre-inoculation T-1053 plasma (data not shown). In addition, HGBV clones 2 (SEQUENCE I.D. NO. 22), 4 (SEQUENCE I.D. NO. 21), 10 (SEQUENCE I.D. NO. 23), 18 (SEQUENCE I.D. NO. 27), 23 (SEQUENCE I.D. NO.28) and 50 (SEQUENCE I.D. NO. 29) sequences could be detected in H205, the HGBV inoculum that was injected into tamarin T-1053 (see Example 1B). These results are summarized in TABLE 8. It should be noted that the HGBV clone sequences were only detected by RT-PCR in the acute phase plasma. The fact that the HGBV clone sequences were detected in the acute phase plasma by PCR only after a reverse transcription step to convert RNA to cDNA, taken together with the limited homology of some of these clones with HCV isolates, and the presence of the sequences coding for the conserved amino acids found in the RNA-dependent RNA polymerase in HGBV clone 10 (SEQUENCE I.D. NO. 23; Example 5) suggest that HGBV is an RNA virus.

RT-PCR analysis of a panel of tamarin plasmas with HGBV clone 16 sequence (SEQUENCE I.D. NO. 26) was undertaken to confirm the presence of HGBV clone 16 (SEQUENCE I.D. NO. 26) in other individuals who had been experimentally infected with HGBV. Briefly, nucleic acids were isolated as previously described (G. G. Schlauder et al.,*J. Virological Methods* 37:189–200 [1992]) from 25 µl of plasma from tamarins obtained prior to and after experimental infection with the H205 inoculum. Ethanol precipitated nucleic acids were resuspended in 3 µl of DEPC-treated $H_2O$. cDNA synthesis and PCR were performed using the GeneAmp RNA PCR Kit from Perkin-Elmer-Cetus essentially according to the manufacturer's instructions. cDNA synthesis was primed with random hexamers. The resulting cDNA was subjected to PCR using clone 16 primers (SEQUENCE I.D. NOS. 93 and 94) at a final concentration of 0.5 µM. PCR was performed for 35 cycles (94° C., 1 min; 55° C., 1 min; 72° C., 1 min) followed by an extension cycle of 72° C. for 7 min. The PCR products were separated by agarose gel electrophoresis and visualized by UV irradiation after direct staining of the nucleic acid with ethidium bromide and/or hybridization to a radiolabelled probe after Southern blot transfer to a nitrocellulose filter as describes in Example 6B.

Figure 19:
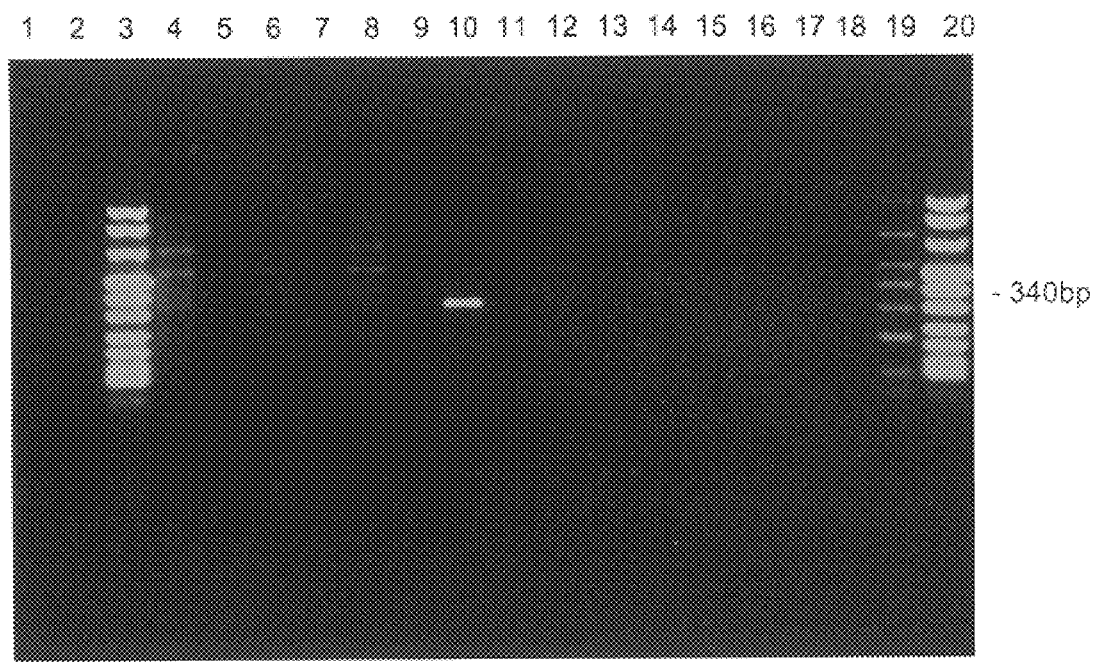
FIG. 19 shows an ethidium bromide stained 1.5% agarose gel of RT-PCR product obtained from normal human serum and pre-inoculation and acute phase tamarin plasmas.
Figure 20:
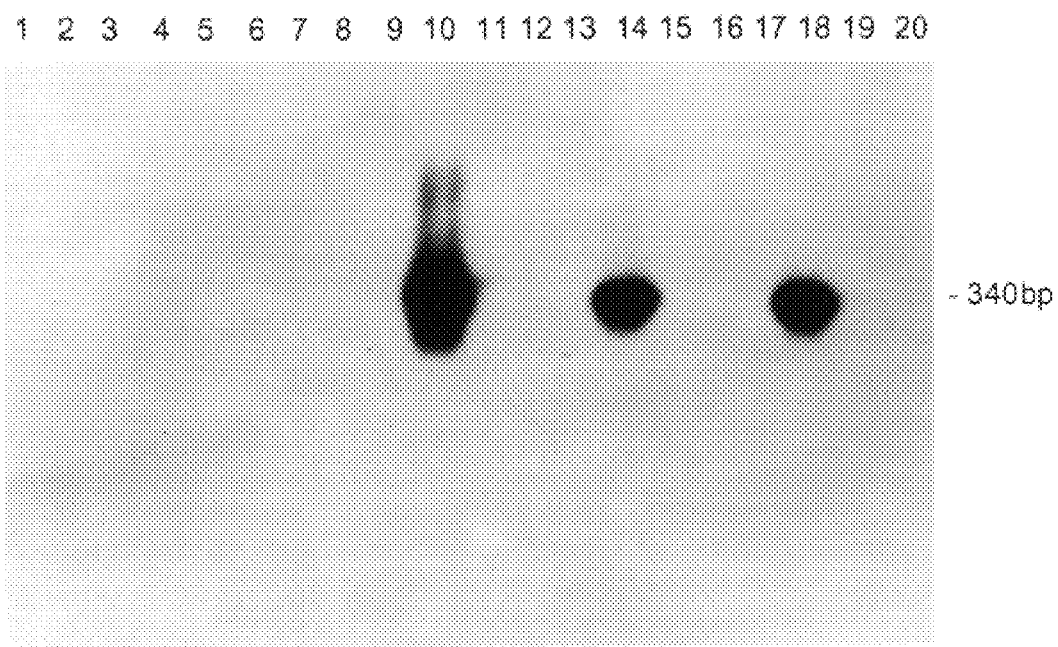
FIG. 20 shows an autoradiogram from a Southern blot of the same gel described in FIG. 19.

FIG. 19 shows an ethidium bromide stained 1.5% agarose gel. FIG. 20 shows an autoradiogram from a Southern blot from the same gel after hybridization to the radiolabeled probe from clone 16 (SEQUENCE I.D. NO. 26). $H_2O$ and normal human serum are shown in lanes 1 and 2. Lanes 3, 19 and 20 are markers. Lanes 4, 8, 12, and 16 are from uninfected tamarin sera while lanes 6, 10, 14 and 18 are from infected tamarin sera. These results show that HGBV clone 16 sequence (SEQUENCE I.D. NO. 26) was detected in other individuals infected with HGBV, in addition to tamarin T-1053, and not in uninfected individuals. Acute phase sera from five H205-infected animals were tested. Clone 16 sequences (SEQUENCE I.D. NO. 26) were detected in sera from three of these animals [lane 10, T-1049, 14 days post-inoculation (dpi); lane 14, T-1051, 28 dpi; lane 18, T-1055, 16 dpi.]. The clone 16 sequence (SEQUENCE I.D. NO. 26) was not detected in pre-inoculation sera from any of the five animals (lane 4, T-1048; lane 8, T1049; lane 12, T-1051; lane 16, T-1055; T-1057 not shown). These results suggest that the clone 16 sequence (SEQUENCE I.D. NO. 26) may be derived from the infectious HGBV agent. The absence of clone 16 sequence (SEQUENCE I.D. NO. 26) in two of five acute phase plasmas (lane 6, T-1048, 28 dpi; T-1057, 14 dpi, not shown) may be explained by the relative low sensitivity of the clone 16 RT-PCR (estimated to be able to detect approximately ≧1000 copies of clone 16 sequence (SEQUENCE I.D. NO. 26) coupled with the acute resolving nature of HGBV infection in tamarins. Thus, the acute plasma from the two negative animals may contain a titer of HGBV that is below the detection level of the RT-PCR assay employed. The observation that these two animals were positive for clone 4 (SEQUENCE I.D. NO.21) by RT-PCR (Example 14) may reflect the presence of RNA sequences of one virus (containing clone 4) and the absence of detectable RNA sequences from a second virus (containing clone 16).

Example 8

Northern Blot Analysis of HGBV Sequences in Infected Tamarin Liver

Because the HGBV clone sequences were detectable by RT-PCR in the acute phase tamarin plasma and the H205 inoculum, it was likely that these sequences originate from the HGBV genome. Additional RT-PCR studies demonstrated the presence of the HGBV sequences in liver RNA extracted from the H205-infected tamarin, T-1053 (data not shown). Therefore, to determine the size of the HGBV genome, Northern analysis of H205-infected and uninfected tamarin liver RNA was performed. Total cellular RNA was extracted from 1.25 g liver of H205-infected tamarin T-1053 and from 1.0 g of liver from a control (i.e. uninfected) tamarin T-1040 using an RNA isolation kit (Stratagene, La Jolla, Calif.) as directed by the manufacturer. Total RNA (30 µg) was electrophoresed through a 1% agarose gel containing 0.6 M formaldehyde (R. M. Fourney, et al., *Focus* 10: 5–7, [1988]) and then transferred to Hybond-N nylon membrane (Amersham) by capillary action in 20×SCC (pH 7.0) as previously described. J. Sambrook, et al., *Molecular Cloning—A Laboratory Manual*, 2nd Edition (1989). The RNA was UV-crosslinked to the nylon membrane which was then baked in a vacuum oven at 80° C. for 60 min. The blots were prehybridized at 60° C. for 2 hours in 25 ml of a solution containing 0.05 M PIPES, 50 mM sodium phosphate, 100 mM NaCl, 1 mM EDTA, and 5% SDS. G. D. Virca, et al., *Biotechniques* 8:370–371 (1990). Prior to hybridization with the radiolabeled DNA probe, the solution was removed and 10 ml of fresh solution was added. The probes used for hybridization were clone 4 (SEQUENCE I.D. NO. 21; 221 bp) and clone 50 (SEQUENCE I.D. NO. 29; 337 bp) and the 2000 bp cDNA encoding human β-actin. P. Gunning, et al., *Mol. and Cell. Biol.* 3:787–795 (1983). The probes (50 ng) were radiolabeled using a random primer labeling kit (Stratagene. La Jolla, Calif.) in the presence of [α-$^{32}$P]dATP as directed by the manufacturer. The specific activity of each probe was approximately $10^9$ cpm/µg. The blots were hybridized at 60° C. for 16 hours and washed as described (G. D. Virca, et al., supra) and then exposed to Kodak X-Omat-AR film at −80° C. Photographs of the resulting autoradiographs are shown in FIG. 21A. Lanes 1, 3, and 5 contain liver RNA from T-1040 and lanes 2, 4, and 6 contain liver RNA from T-1053. Lanes 1 and 2 were hybridized with the human β-actin cDNA probe; lanes 3 and 4 were hybridized with the clone 4 probe (SEQUENCE I.D. NO. 21); and lanes 5 and 6 were hybridized with the clone 50 probe (SEQUENCE I.D. NO. 29). Exposure times were as follows: lanes 1 and 2, 5 hours at −80° C.; lanes 3–6, 56 hours at −80° C. The positions of the 28S and 18S ribosomal RNAs are indicated by the arrows. The relative sizes of these ribosomal RNAs are 6333 and 2366 nucleotides, respectively. J. Sambrook, et al., supra.

Clone 4 (SEQUENCE I.D. NO. 21) and clone 50 probes (SEQUENCE I.D. NO. 29) hybridized with an RNA species present in RNA extracted from the liver of the infected tamarin (T-1053) (FIG. 21A, lanes 4 and 6). The size of this hybridizable RNA species was calculated at approximately 8300 nucleotides based on its relative mobility with respect to 28S and 18S ribosomal RNAs. Both probes appear to hybridize to the same RNA species. Neither probe hybridized with RNA extracted from the liver of the uninfected tamarin (T-1040) (FIG. 21A, lanes 3 and 5). These results suggest that the sequences of clones 4 (SEQUENCE I.D. NO. 21) and 50 (SEQUENCE I.D. NO. 29) are present within the same 8.3 Kb transcript.

Figure 21B:
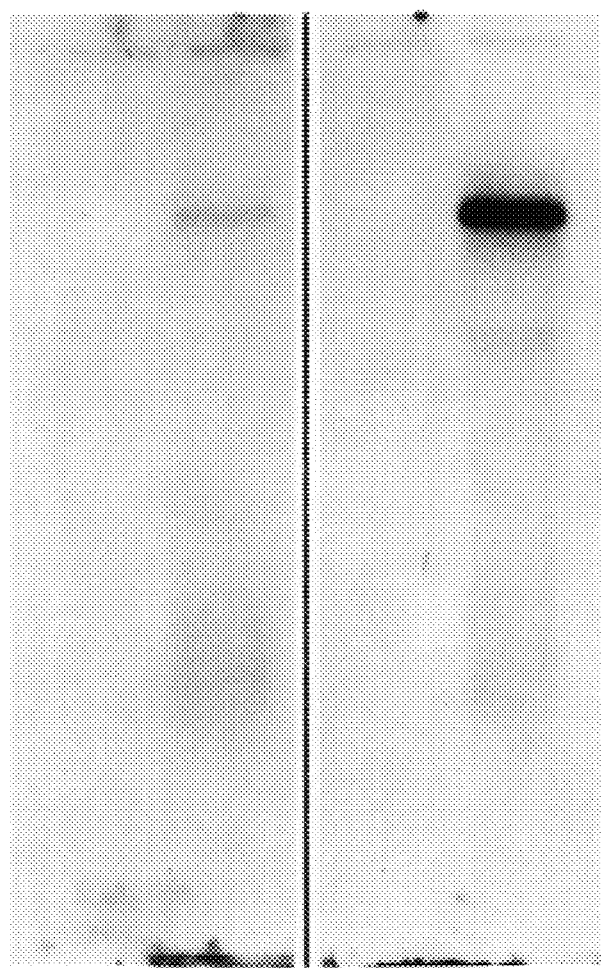
FIGS. 21A and B show autoradiograms from Northern blots of total cellular RNA extracted from the liver of an uninfected tamarin and an HGBV-infected tamarin.

In order to determine the strandedness of the HGBV RNA genome, strand-specific radiolabeled DNA probes were prepared by assymetric PCR using the GeneAmp® PCR kit from Perkin-Elmer essentially according to the manufacturer's instructions. Purified clone 50 DNA (SEQUENCE I.D. NO. 29) was used as template in separate reactions containing either the clone 50 negative strand-specific primer (SEQUENCE I.D. NO. 99) or the clone 50 positive strand-specific primer (SEQUENCE I.D. NO. 100) at 1 μM final concentrations. The reaction mixture contained [α$^{32}$P-dATP] (Amersham; 3000 Ci/mmol) in place of the dATP normally included in the reaction mixture. Following 30-cycles of linear amplification of the template, the unincorporated [α$^{32}$P-dATP] was removed by Quick-Spin® Sephadex G50 spin columns (Boehringer-Mannheim, Indianapolis, Ind.) according to the manufacturer's instructions. Hybridization of the radiolabeled probes to DNA dot blots containing ten-fold serial dilutions of double-stranded clone 50 DNA (SEQUENCE I.D. NO. 29) demonstrated that the two probes possessed nearly identical sensitivities (data not shown). The radiolabled probes were then hybridized to RNA blots containing 30 μg of total liver RNA extracted from uninfected tamarin T-1040 and from infected tamarin T-1053 as described above. Photographs of the resulting autoradiographs are shown in FIG. 21B. Lanes 1 and 3 contain liver RNA from T-1040 and lanes 2 and 4 contain liver RNA from T-1053. Lanes 1 and 2 were hybridized with the clone 50 positive strand probe (i.e., the positive strand is radiolabeled and will detect the negative strand; SEQUENCE I.D. NO. 100); lanes 3 and 4 were hybridized with the clone 50 negative strand probe (i.e., the negative strand is radiolabeled and will detect the positive strand; SEQUENCE I.D. NO.99). The blots were exposed for 18 hours at −80° C. The positions of the 28S and 18S ribosomal RNAs are indicated by the arrows.

As shown in FIG. 21B, the clone 50 positive and negative strand probes (SEQUENCE I.D. NOS.100 and 99, respectively) hybridized to an RNA species of approximately 8.3 kilobases extracted from the liver of the infected tamarin T-1053 (FIG. 21B, lanes 2 and 4), but not to RNA extracted from the liver of the uninfected tamarin T-1040 (FIG. 21B, lanes 1 and 3). This is consistent with the Northern blot results obtained with the clone 4 (SEQUENCE I.D. NO. 21) and clone 50 (SEQUENCE I.D. NO. 29) double-stranded probes shown above. The more intense signal obtained with the clone 50 negative strand probe (SEQUENCE I.D. NO. 99) (FIG. 21B, lane 4 vs. lane 2) suggests that the predominant RNA species present in the liver of infected tamarins is the positive (i.e. coding) strand.

Example 9

Extending the HGBV Clone Sequence

A. Generation of HGBV Sequences

The clones obtained as described in Example 3 and sequenced as described in Example 5 hereinabove appear to be derived from separate regions of the HGBV genome. Therefore, to obtain sequences from additional regions of the HGBV genome that reside between the previously identified clones, and to confirm the sequence of the RDA clones, several PCR walking experiments were performed.

Total nucleic acids were extracted from 50 μl aliquots of infectious T-1053 plasma as described in Example 3(A). Briefly, precipitated nucleic acids were resuspended in 10 μl DEPC-treated $H_2O$. Standard RT-PCR was performed using the GeneAmp® RNA PCR kit (Perkin Elmer) as directed by the manufacturer. Briefly, PCR was performed on the cDNA products of random primed reverse transcription reactions of the extracted nucleic acids with 2 mM $MgCl_2$ and 1 μM primers. Reactions were subjected to 35 cycles of denaturation-annealing-extension (94° C., 30 sec; 55° C., 30 sec; 72° C. 2 min) followed by a 3 min extension at 72° C. The reactions were held at 4° C. prior to agarose gel analysis. These products were cloned into pT7 Blue T-vector plasmid (Novagen) as described in the art. TABLE 9 presents the results obtained when these reactions were performed.

TABLE 9

| Reaction | Primer 1 | Primer 2 | Product Size |
|---|---|---|---|
| 1.1 | SEQ ID #88 | comp. of SEQ ID #93 | 878 bp |
| 1.2 | comp. of SEQ ID #87 | SEQ ID #97 | 1191 bp |
| 1.3 | SEQ ID #90 | SEQ ID #101 | 864 bp |
| 1.4 | comp. of SEQ ID #99 | comp. of SEQ ID #102 | 1.4 kb |
| 1.5 | SEQ ID #102 | SEQ ID #91 | 672 bp |
| 1.6 | SEQ ID #98 | SEQ ID #99 | 2328 bp |
| 1.7 | comp of SEQ ID #103 | SEQ ID #104 | 1300 bp |
| 1.8 | comp. of SEQ ID #105 | SEQ ID #87 | 900 bp |
| 1.9 | SEQ. ID. #93 | SEQ. ID. #99 | 2323 bp |
| 1.10 | SEQ. ID. #92 | SEQ. ID. #91 | 1216 bp |
| 1.11 | SEQ. ID. #90 | SEQ. ID. #92 | 1570 bp |
| 1.12 | comp. of SEQ ID #106 | SEQ ID #103 | 550 bp |
| 1.13 | comp. of SEQ ID #107 | SEQ ID #108 | 900 bp |
| 1.14 | SEQ ID #107 | comp. of SEQ ID #96 | 1100 bp |
| 1.15 | comp. of SEQ ID #109 | SEQ ID #110 | 410 bp |
| 1.16 | SEQ ID #111 | comp. of SEQ #112 | 600 bp |
| 1.17 | comp. of SEQ ID #113 | SEQ ID #114 | 1000 bp |
| 1.18 | SEQ ID #98 | comp. of SEQ ID #115 | 720 bp |
| 1.19 | comp. of SEQ ID #116 | comp. of SEQ ID #117 | 825 bp |
| 1.20 | SEQ ID #118 | comp. of SEQ ID #119 | 700 bp |
| 1.21 | SEQ ID #120 | SEQ ID #95 | 900 bp |
| 1.22 | SEQ ID #121 | comp. of SEQ ID #122 | 950 bp |
| 1.23 | SEQ ID #123 | SEQ ID #124 | 420 bp |
| 1.24 | SEQ. ID #87 | SEQ. ID #88 | 130 bp |
| 1.25 | SEQ. ID #55 | SEQ. ID #89 | 450 bp |

A modification of a PCR walking technique described by Sorensen et al. (*J. Virol.* 67:7118–7124 [1993]) was utilized to obtain additional HGBV sequences. Briefly, total nucleic acid were extracted from infectious tamarin T-1053 plasma and reverse transcribed. The resultant cDNAs were amplified in 50 μl PCR reactions (PCR 1) as described by Sorensen et al. (upra) except that 2 mM $MgCl_2$ was used. The reactions were subjected to 35 cycles of denaturation-annealing-extension (94° C., 30 sec; 55° C., 30 sec; 72° C., 2 min) followed by a 3 min extension at 72° C. Biotinylated products were isolated using streptavidin-coated paramagnetic beads (Promega) as described by Sorensen et al. (supra). Nested PCRs (PCR 2) were performed on the streptavidin-purified products as described by Sorensen et al. for a total of 20 to 35 cycles of denaturation-annealing-extension as described above. The resultant products and the PCR primers used to generate them are listed in TABLE 10.

TABLE 10

| Reaction product | Primer set PCR 1 | Primer set PCR 2 | Size of PCR |
|---|---|---|---|
| 2.1 | SEQ ID #103/ SEQ ID #125 | SEQ ID #668/ SEQ ID #126 | 500 bp |
| 2.2 | SEQ ID #114/ SEQ ID #125 | SEQ ID #105/ SEQ ID #126 | 1000 bp |
| 2.3 | SEQ ID #92/ SEQ ID #125 | SEQ ID #123/ SEQ ID #126 | 400 bp |
| 2.4 | SEQ ID #127/ SEQ ID #128 | comp. of SEQ ID #88/ SEQ ID #126 | 420 bp |
| 2.5 | SEQ ID #108/ SEQ ID #128 | SEQ ID #106/ SEQ ID #126 | 900 bp |
| 2.6 | SEQ ID #129/ SEQ ID #125 | SEQ ID #98/ SEQ ID #126 | 750 bp |
| 2.7 | SEQ ID #116/ SEQ ID #128 | SEQ ID #115/ SEQ ID #126 | 825 bp |
| 2.8 | SEQ ID #130/ SEQ ID #125 | SEQ ID #107/ SEQ ID #126 | 630 bp |

TABLE 10-continued

| Reaction product | Primer set PCR 1 | Primer set PCR 2 | Size of PCR |
|---|---|---|---|
| 2.9 | SEQ ID #110/ SEQ ID #135 | SEQ ID #131/ SEQ ID #126 | 390 bp |
| 2.10 | SEQ ID #132/ SEQ ID #125 | SEQ ID #109/ SEQ ID #126 | 1000 bp |
| 2.11 | SEQ ID #111/ SEQ ID #128 | SEQ ID #133/ SEQ ID #126 | 600 bp |
| 2.12 | SEQ ID #134/ SEQ ID #135 | SEQ ID #112/ SEQ ID #126 | 580 bp |
| 2.13 | SEQ ID #136/ SEQ ID #125 | SEQ ID #137/ SEQ ID #126 | 400 bp |
| 2.14 | SEQ ID #138/ SEQ ID #128 | SEQ ID #113/ SEQ ID #126 | 500 bp |
| 2.15 | SEQ ID #139/ SEQ ID #128 | SEQ ID #140/ SEQ ID #126 | 900 bp |
| 2.16 | SEQ ID #121/ SEQ ID #135 | SEQ ID #141/ SEQ ID #126 | 400 bp |
| 2.17 | SEQ ID #142/ SEQ ID #125 | comp. of SEQ ID #102/ SEQ ID #126 | 1000 bp |
| 2.18 | SEQ ID #143/ SEQ ID #135 | SEQ ID #144/ SEQ ID #126 | 550 bp |
| 2.19 | SEQ ID #87/ SEQ ID #125 | SEQ ID #90/ SEQ ID #126 | 220 bp |

These products were isolated from low melting point agarose gels and cloned into pT7 Blue T-vector plasmid (Novagen) as described in the art.

RNA ligase-mediated 5' RACE (rapid amplification of cDNA ends) was employed to obtain the 5' end sequences from viral genomic RNAs as described hereinabove. Briefly, the 5' AmpliFINDER™ RACE kit (Clontech, Palo Alto, Calif.) was used as directed by the manufacturer. The source of the viral RNA was acute phase T-1053 plasma that was extracted as described above. The virus-specific oligonucleotides utilized for the reverse transcription (RT), the first PCR amplification (PCR 1) and the second PCR amplification (PCR 2) are listed in TABLE-11. The ligated anchor primer and its complementary PCR primer were provided by the manufacturer. PCRs were performed with the Gene-Amp® PCR kit (Perkin Elmer) as directed by the manufacturer.

TABLE 11

| Reaction | RT primer | PCR 1 primer | PCR 2 primer | Size of PCR 2 product |
|---|---|---|---|---|
| 3.1 | SEQ ID #145 | SEQ ID #146 | SEQ ID #147 | 190 bp |
| 3.2 | SEQ ID #148 | SEQ ID #149 | SEQ ID #150 | 620 bp |

The products generated by RNA ligase-mediated 5' RACE were isolated from low melting point agarose gels and cloned into pT7 Blue T-vector plasmid (Novagen) as described in the art.

To obtain additional sequence at the 5' and 3' ends of HGBV-B SEQUENCE (see below, Evidence for the existence of two HCV-like flaviviruses in HGBV), an RNA circularization experiment was performed. (This method is based on that described by C. W. Mandl et al. (1991) *Biotechniques,* Vol 10 (4): 485–486.) Total nucleic acids were purified from 50 μl of T-1057 plasma (14 days post H205 inoculation except that 1 μg glycogen replaced the tRNA in the precipitation. The nucleic acid pellet was dissolved in 16.3 μl of DEPC-treated water, and 25 μl of 2×TAP buffer (1×=50 mM NaOAC, pH 5.0, 1 mM EDTA, mM 2-mercaptoethanol, 2 mM ATP) and 8.7 μl of tobacco acid pyrophophatase (20 Units; Sigma) were added. The mixture was incubated at 37° C. for 60 min. The sample was extracted with phenol (water-saturated) followed by chloroform and then precipitated with NaOAC/EtOH in the presence of glycogen (1 μg). The pellet was dissolved in 83 μl of DEPC water and 10 μl of 10×RNA ligase buffer (New England Biolabs, NEB), 2 μl of RNase inhibitor (Perkin Elmer), and 5 μl of T4 RNA ligase (NEB) was then added. The mixture was incubated at 4° C. for 16 hours. The sample was then extracted with phenol (water-saturated) and then chloroform as before and then precipitated with NaOAC/EtOH.

One-tenth of the ligated RNA was used in the reverse transcriptase (RT) reaction using Superscript RT (GIBCO/BRL) and SEQUENCE ID. NO. 146 as the primer as directed by the manufacturer. One-half of the RT reaction mix was used for PCR1 in the presence of a biotinylated oligonucleotide primer (SEQUENCE ID. NO. 146) and and a second oligonucleotide primer (SEQUENCE ID. NO. 133) as described above. PCR1 products were purified from the reaction mixture using streptavidin-magnetic beads as described by Sorensen et al. Purified PCR1 products (2 μl out of 30 μl) were used as the template for PCR2. PCR2 using oligonucleotide primers (SEQUENCE ID. NOS. 147 and 154) yielded a 1200 bp product that was cloned into pT7 Blue T-vector plasmid and sequenced as described below. Sequence analysis of two independent clones from this experiment demonstrated 100% identity in the region of overlap with known sequence (although one clone possessed a sequence of 18 T residues and the other a sequence of 27 T residues), and an additional 270 bases of new sequence.

The above circularization experiment provided sequence from both the 5'- and 3'-ends of the HGBV-B viral genome that was not obtained using standard 3'- or 5'-RACE techniques. However, the exact 5'-3' junction is difficult to determine even after additional PCR experiments are performed using primers designed from the newly obtained sequence. Thus, in order to better characterize the 5'-end of the HGBV-B RNA genome a primer extension experiment was performed using RNA isolated from the liver of T-1053.

Total cellular RNA was isolated from the liver of T-1053 and a control (i.e. uninfected) animal (T-1040) as described in Example 7. An antisense oligonucleotide (SEQUENCE I.D. NO. 155) was endlabeled with $\gamma$-$^{32}$P-ATP using T4 polynucleotide kinase (NEB) to a specific activity of approximately $9.39\times10^{7}$ CPM/μg as described (Sambrook et al.). The primer was annealed to 30 μg of T-1053 and T-1040 liver RNA in separate reactions and then extended using MMLV reverse transcriptase (Perkin-Elmer) as previously described (Sambrook et al). The products were analyzed on a 6% sequencing gel. A sequence ladder generated from one of the HGBV-B circularization clones using the same primer as that utilized for the primer extension served as a size standard.

Primer extension products of 176 bp were obtained from T-1053. These products were not obtained when primer extension was performed using liver RNA from an uninfected animal (T-1040) and therefore represent products derived from the HGBV-B genome. The length of the products obtained indicate that the 5'-end of the genome, as present in the liver of infected animals, is located 442 nucleotides upstream of the initiator AUG codon.

To confirm the 3' location of the sequence obtained in the circularization experiment, RT-PCRs were performed using primers designed to the predicted 3' termini (see reaction 1.25, TABLE 2). RT-PCR of infectious T-1053 plasma as (described above) using SEQUENCE ID. NOS. 156 and SEQUENCE ID. NO. 157 yielded a product of 450 bp. In contrast, RT-PCR using the complement of SEQUENCE ID.

NO. 157 and SEQUENCE I.D. NO. 147 did not yield a detectable PCR product (data not shown). These data suggest that the 3' end of the genome is located 50 nucleotides downstream of the poly T tract.

Figure 22:
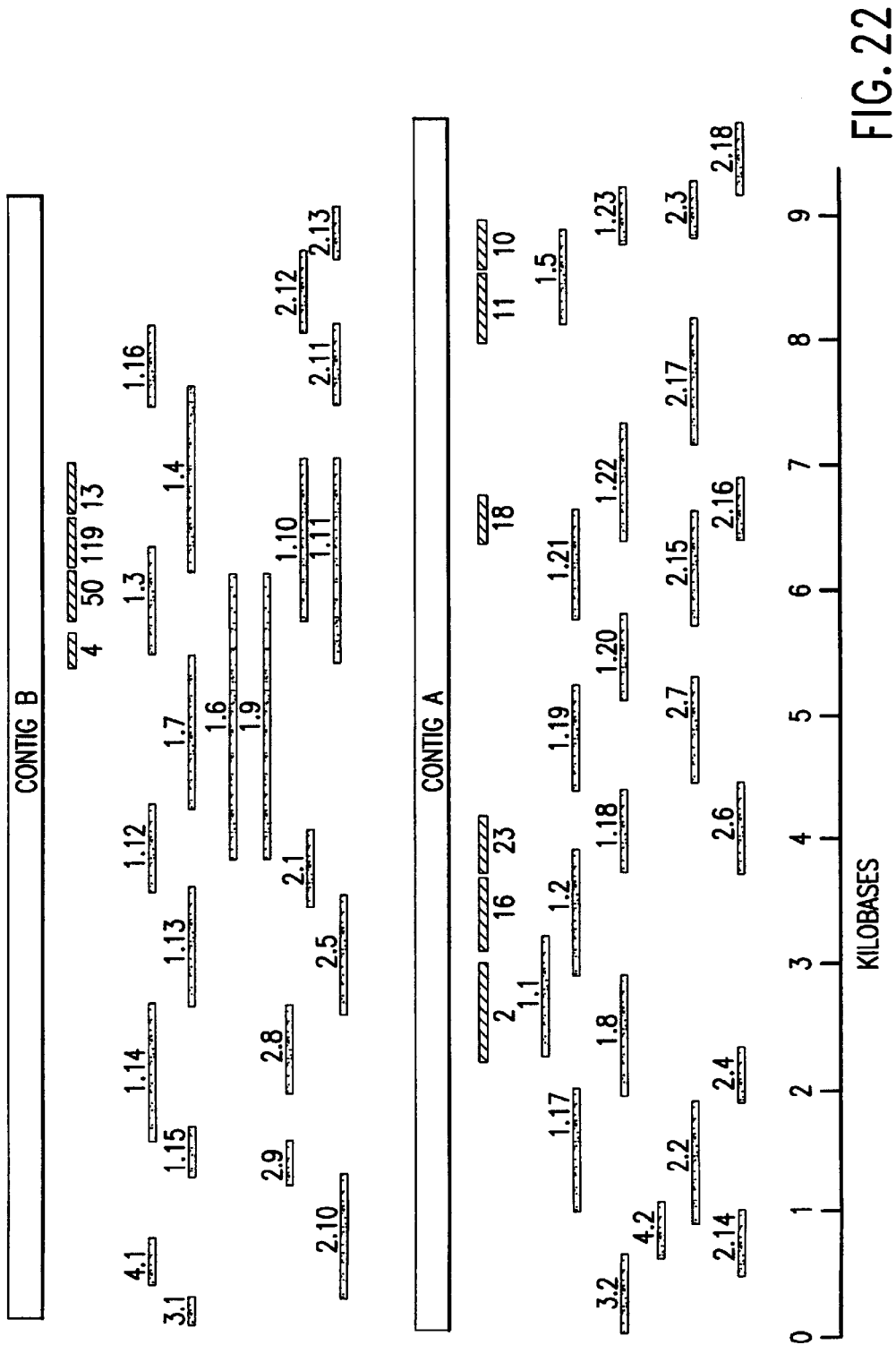
FIG. 22 shows a diagram that demonstrates each of the recombinant polynucleotide isolates are present on contiguous RNA species.

The cloned products from TABLES 9, 10 and 11, and the RNA circularization experiment were sequenced as previously described in Example 5.Interestingly, the cloned products of reactions 1.4, 1.6, 1.9, 1.10 and 1.11 were found to contain only one of the two primer sequences at the termini, suggesting that these products were the result of false priming events. PCR/sequencing experiments have linked sequences detected in products 1.4, 1.6, 1.9, 1.10 and 1.11 with clone 4 (SEQUENCE I.D. NO. 21) and/or clone 50 (SEQUENCE I.D. NO. 29). In addition, sequences derived from each of these reactions contain limited HCV identity. Thus, these products, although a result of false priming at one end of the PCR product, appear to contain authentic HGBV sequence. The product from reaction 1.14 also appeared to be a result of false priming. Here, the complement of SEQUENCE I.D. NO. 160 is found at the 5' end of the product from reaction 1.14 (GB-B, FIG. 22). This was unexpected because SEQUENCE I.D. NO. 160 was derived from SEQUENCE I.D. NO. 161 which resides in GB-A. However, the sequence identity between products from reactions 1.14 and 2.8, together with additional PCRs/sequencing experiments (data not shown), demonstrate that reaction 1.14 contains authentic HGBV sequence. Apparently, the complement of SEQUENCE I.D. NO. 160 had enough identity to GB-B sequences upstream of SEQUENCE I.D. NO. 162 to act as a PCR primer.

The sequences obtained from the products described in TABLES 9, 10 and 11 hereinabove, and the RNA circularization experiment were assembled into contigs using the GCG Package (version 7) of programs. A schematic of the assembled contigs is presented in FIG. 22). GB contig A (GB-A) is 9493 bp in length, all of which has been sequenced and is presented in SEQUENCE I.D. NO. 163. GB-A includes clones 2 (SEQUENCE I.D. NO. 22), 16 (SEQUENCE I.D. NO. 26), 23 (SEQUENCE I.D. NO. 28), 18 (SEQUENCE I.D. NO. 27), 11 (SEQUENCE I.D. NO. 24) and 10 (SEQUENCE I.D. NO. 23). SEQUENCE I.D. NO. 163 was translated into three possible reading frames and is presented in the Sequence Listing as SEQUENCE I.D. NOS. 165–389. GB contig B (GB-B) is 9143 bp and is presented in SEQUENCE I.D. NO. 390. GB-B (SEQUENCE I.D. NO. 390) includes clones 4 (SEQUENCE I.D. NO. 21), 50 (SEQUENCE I.D. NO. 29), 119 (SEQUENCE I.D. NO. 30) and 13 (SEQUENCE I.D. NO. 25). SEQUENCE I.D. NO. 390 was translated into one open reading frame and is presented in the Sequence Listing as SEQUENCE I.D. 393 and 394. The UTRs from the 5' and the 3' ends can each be translated into six reading frames.

B. Evidence for the Existence of Two HCV-like Viruses in HGBV

1. Evidence for GB-A and GB-B Representing Two Distinct RNA Species

Figure 23A:
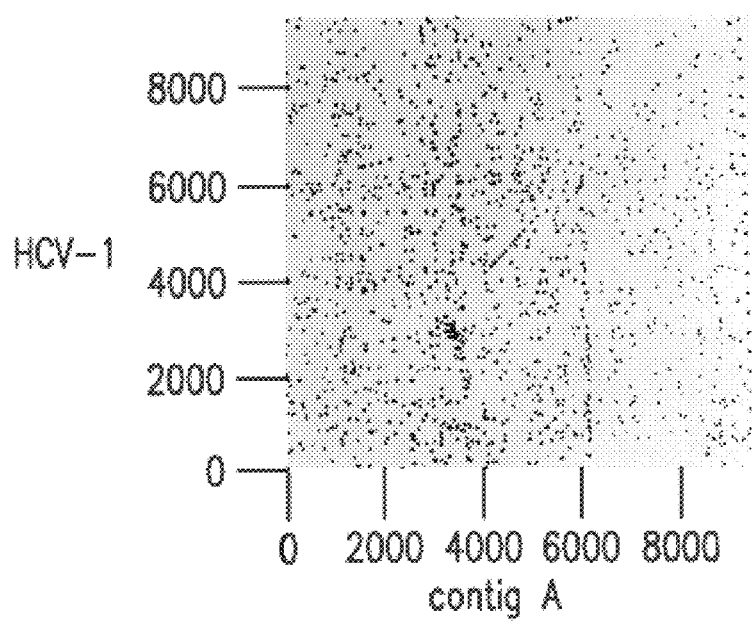
Figure 23B:
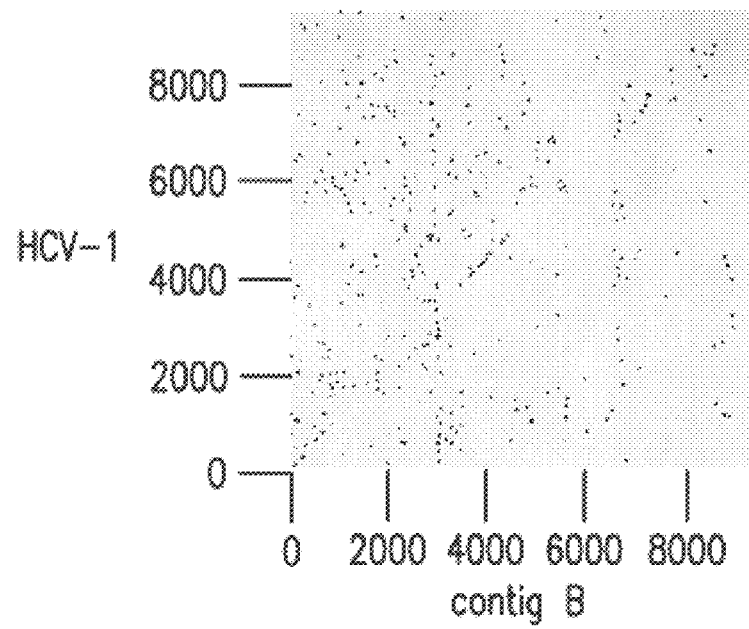
Figure 23C:
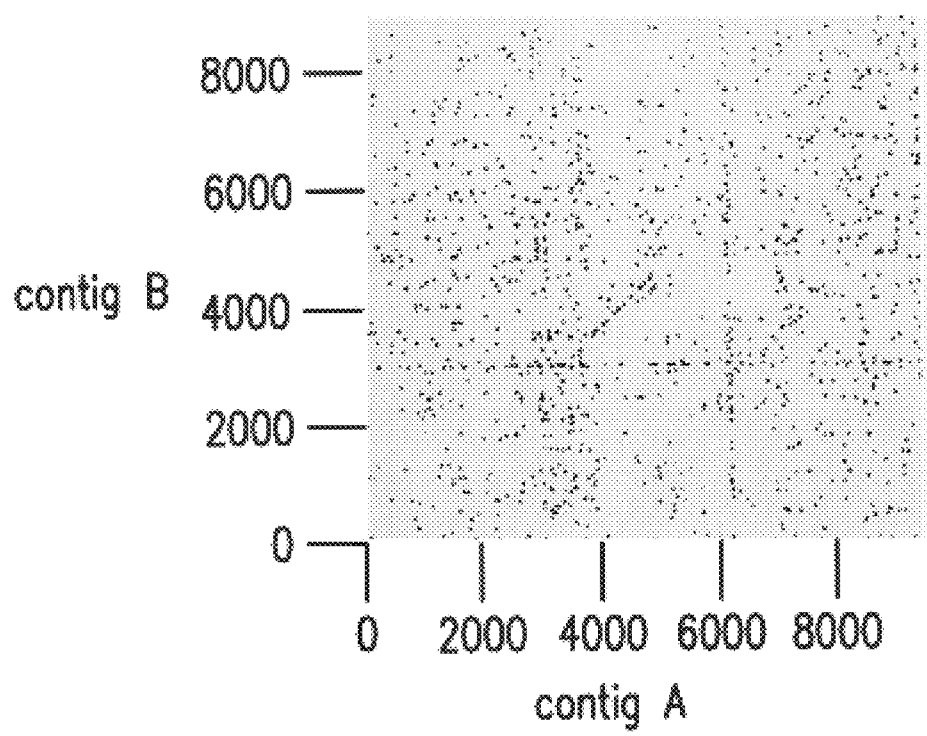

Comparison of GB-A (SEQUENCE ID. NO. 163) GB-B (SEQUENCE I.D. NO. 390) and HCV-1 (GenBank accession # M67463) demonstrate that GB-A (SEQUENCE I.D. NO. 163), GB-B (SEQUENCE I.D. NO. 390) and HCV-1 are all distinct sequences. Dot plot analyses of the nucleic acid sequences of G-BA (SEQUENCE I.D. NO. 163), GB-B (SEQUENCE I.D. NO. 390) and HCV-1 were performed using the GCG Package (version 7). Using a window size of 21 and a stringency of 14, GB-A (SEQUENCE I.D. NO. 163), GB-B (SEQUENCE I.D. NO. 390) and HCV-1 were found to clearly contain different nucleotide sequences (FIG. 23). Therefore, GB-A (SEQUENCE I.D. NO. 163) and GB-B (SEQUENCE I.D. NO. 390) do not represent different strains or genotypes of HCV or of each other. Short regions of limited nucleotide identity are found in the putative NS3-like and NS5b-like sequences of GB-A (SEQ. ID. NO. 163) and GB-B (SEQ. ID. NO. 390) and the NS3 and NS5b sequences of HCV by this analysis. However, nucleotide identity in these regions is not surprising because NS3S and NS5b code for the putative NTP-binding helicase and the RNA-dependent RNA polymerase, respectively, which are conserved in all flaviviruses (see below). That GB-A (SEQUENCE I.D. NO. 163) and GB-B (SEQUENCE I.D. NO. 390) represent separate RNA molecules and not different regions of the same RNA molecule is evidenced by the 5' RACE experiments (above) and supported by the Northern blot data (as described in Example 8. First, the 5' RACE experiments show distinct 5' ends for GB-A (SEQUENCE I.D. NO. 163) and GB-B (SEQUENCE I.D. NO. 390). Because RNA molecules can contain only one 5' end, GB-A (SEQUENCE I.D. NO. 163) and GB-B (SEQUENCE I.D. NO. 390) represent separate RNA molecules. Second, the 8300 base RNA molecule detected in infected tamarin liver RNA by probing Northern blots with clones 4 and 50 (SEQUENCE I.D. NOS. 21 and 29, respectively), both from GB-B [SEQUENCE I.D. NO. 390], see Example 8, corresponds closely to the size of GB-B (SEQUENCE I.D. NO. 390, 9143 bp). If GB-A and GB-B were part of the same RNA molecule, one would expect a Northern blot product of at least 17,000 bases. These data demonstrate that GB-A (SEQUENCE I.D. NO. 163) and GB-B (SEQUENCE I.D. NO. 390) represent the nucleotide sequences of two distinct RNA molecules that are not variants of HCV or each other.

Northern blot analysis and PCR studies of T-1053 provided evidence that the two RNA species corresponding to GB-A (SEQUENCE I.D. NO. 163) and GB-B (SEQUENCE I.D. NO. 390) were not at equivalent levels in the liver. As stated above, clones 4 and 50 (SEQUENCE I.D. NOS. 21 and 29, respectively), both from the GB-B (SEQUENCE I.D. NO. 390), hybridized to an 8.3 kb RNA species present in infected liver of T-1053 (as described in Example 8). In contrast, clones 2 (SEQUENCE I.D. NO. 22), 10 (SEQUENCE I.D. NO. 23), 16 (SEQUENCE I.D. NO. 26 and 23 (SEQUENCE I.D. NO. 28), all from GB-A (SEQUENCE ID. NO. 163), showed no hybridization with T-1053 liver RNA in identical experiments (data not shown). In addition, clone 16 PCR generated much less product than clone 4 PCR on cDNAs generated from T-1053 liver RNA by ethidium staining, despite equivalent sensitivities of clone 4 and clone 16 PCRs demonstrated using plasmid templates (data not shown). This is in contrast to what is found in T-1053 plasma at the time of sacrifice. PCR titration experiments for clone 4 (GB-B-specific, SEQUENCE I.D. NO. 390) and clone 16 (GB-A-specific, SEQUENCE I.D. NO. 163) PCR on cDNAs generated from T-1053 plasma RNA suggest that equivalent amounts of GB-A (SEQUENCE I.D. NO. 163) RNA and GB-B (SEQUENCE I.D. NO. 390) RNA are present in T-1053 plasma (Example 4, E.2). Thus, although GB-A (SEQUENCE I.D. NO. 163) RNA and GB-B (SEQUENCE I.D. NO. 390) RNA were at equivalent levels in T-1053 plasma, there appeared to be a greater amount of GB-B (SEQUENCE I.D. NO. 390) RNA relative to GB-A (SEQUENCE I.D. NO. 163) RNA present in T-1053 liver at the time of sacrifice. Together, these results provide further evidence for the existence of two different RNA molecules corresponding to GB-A (SEQUENCE I.D. NO. 163) and GB-B (SEQUENCE I.D. NO. 390) in T-1053 plasma and suggest that these RNAs are not necessarily present at equivalent levels in infected liver RNA. Therefore, it is unlikely that GB-A (SEQUENCE I.D. NO. 163) and GB-B (SEQUENCE I.D. NO. 390) make up individual segments of a single viral genome.

2. Evidence that GB-A (SEQUENCE I.D. NO. 163) and GB-B (SEQUENCE I.D. NO. 390) Represent the Genomes of Two Distinct Viruses Infectivity and PCR studies provide evidence for the viral nature of GB-A (SEQUENCE I.D. NO. 163) and B (SEQUENCE I.D. NO. 390). Specifically, tamarins T-1049 and T-1051 which were inoculated with T-1053 plasma that had been filtered (0.1 $\mu$m) and diluted to $10^{-4}$, or unfiltered and diluted to $10^{-5}$, respectively, were positive for both clone 4 (GB-B [SEQUENCE I.D. NO. 390]) and clone 16 (GB-A [SEQUENCE I.D. NO. 163]) sequences. Prior to inoculation, both of these animals were negative for clones 4 and 16 (Examples 4, E.4 and 4, E.5). Therefore, the two RNA species present in the acute phase T-1053 plasma corresponding to GB-A and GB-B can be filtered, diluted and passaged to other animals consistent with the proposed viral nature of GB-A (SEQUENCE I.D. NO. 163) and GB-B (SEQUENCE I.D. NO. 390). That GB-A and GB-B represent RNA molecules from separate viral particles is evidenced by PCR studies of the H205-inoculated tamarins. Specifically, four of four tamarins became positive for clone 4 (GB-B [SEQUENCE I.D. NO. 390]) by RT-PCR after H205 inoculation. In contrast, only one of 4 H205-inoculated tamarins (T-1053) became positive for clone 16 (GB-A [SEQUENCE I.D. NO. 163]) by RT-PCR (Example 4.E.2). Therefore, assuming that GB-A (SEQUENCE I.D. NO. 163) sequences were truly absent from T-1048, T-1057 and T-1061, and that the negative clone 16 PCR results were not due to poor sensitivity, it would appear that the virus corresponding to GB-B (SEQUENCE I.D. NO. 390) sequences (i.e. hepatitis GB virus B [HGBV-B]) can be passaged independent of GB-A (SEQUENCE I.D. NO. 163) sequences. An HGBV-B only sample from T-1057 has been passaged two additional times (Example 4). GB-A (SEQUENCE I.D. NO. 163) sequences have not been detected in these animals by RT-PCR. In addition, significant liver enzyme elevations have been noted in these animals (Example 4), demonstrating that HGBV-B alone caused hepatitis in tamarins. GB-A (SEQUENCE I.D. NO. 163) sequences have been identified in tamarins lacking detectable GB-B (SEQUENCE I.D. NO. 390) sequences. Specifically, GB-B only animals (T-1048, T-1057 and T-1061) challenged with T-1053 plasma developed GB-A (SEQUENCE I.D. NO. 163) only viremias as detected by clone 16 specific RT-PCR. The GB-A only plasma from T-1057 has been passaged one additional time (Example 4). Thus, it appears that a virus corresponding to GB-A (SEQUENCE I.D. NO. 163) sequences (hepatitis GB virus A [HGBV-A]) can replicate independent of HGBV-B. Additional passages of HGBV-A in the absence of HGBV-B is ongoing. At this time it is not known whether HGBV-A causes hepatitis in tamarins. However, the lack of elevated liver enzymes noted in the T-1053 challenged tamarins with HGBV-A viremias and in the passage of the HGBV-A only serum from T-1057 argue against the hepatotropic nature of HGBV-B in tamarins.

The presence of two viruses in acute phase T-1053 plasma can be traced back to the H205 inoculum. Specifically, data from Example 7 showed that clone 16 (SEQUENCE I.D. NO.26, found in GB-A [SEQUENCE I.D. NO. 163]) was absent in the preinoculation plasma from all 7 tamarins tested. In addition, clones 2, 10, 18 and 23 (SEQUENCE I.D. NOS. 22, 23, 27 and 28, respectively, all from GB-A [SEQUENCE I.D. NO. 163]) have not been detected in any pre-HGBV-inoculated tamarin plasma tested (Example 7. Similar negative results were found when preinoculation tamarin plasma were tested for clones 4 and 50 (SEQUENCE I.D. NOS. 21 and 29, respectively, all from GB-B [SEQUENCE I.D. NO.390]). Thus, both HGBV-A and HGBV-B were absent in the preinoculation tamarin plasma. In contrast, all of these clones (i.e. clones 2, 10, 16, 18 and 23 from GB-A [SEQUENCE I.D. NO. 163], and clones 4 and 50 from GB-B [SEQUENCE I.D. NO. 390]) were detected in the H205 noculum (TABLE 7). Interestingly, as found in cDNA made from T-1053 liver (above), several different PCR targets in GB-A (SEQUENCE I.D. NO. 163) all generated less product than similar PCR targets in GB-B (SEQUENCE I.D. NO. 390) using the same random primed cDNAs from H205 (data not shown). Thus, we conclude that HGBV-A and HGBV-B are present in the original GB inoculum, H205. However, HGBV-B appears to be more abundant than HGBV-A in H205. The low relative amount of HGBV-A in the H205 inoculum may explain why only one of four tamarins were positive for the HGBV-A after H205 inoculation (Example 4.E.2).

3. Evidence that HGBV-A and HGBV-B are Members of the Flaviviridae

Searches of the SWISS-PROT database with the three frame translation products of GB-A (SEQUENCE I.D. NO. 164–396) and GB-B (SEQUENCE I.D. NO. 394) as described in Example 5 show limited, but significant amino acid sequence identity with various strains of HCV. Translation products from GB-A (SEQUENCE I.D. NO. 163) and GB-B (SEQUENCE I.D. NO. 390) show the closest homology to regions of the nonstructural proteins of various HCV isolates (i.e. NS2, NS3, NS4 and NS5). For example, as shown in FIG. 24, the conserved residues (indicated by *) in the putative NTP-binding helicase domain of flaviviruses (FIG. 24A) and in the RNA-dependent RNA polymerase domain of all viral RNA-dependent RNA polymerases (FIG. 24B) are held in common between HCV-1NS3S and NS5b (SWISS-PROT accession number p26664), respectively, and the predicted translation products of GB-A SEQUENCE I.D. NO. 390) and GB-B (SEQUENCE I.D. NO. 397). (See Choo et al., *PNAS* 88:2451–2455 [1991] and Domier et al., *Virology* 158:20–27 [1987]). Therefore, it appears that both GB-A virus and GB-B virus encode functional NTP-binding helicases and RNA-dependent RNA polymerases. However, GB-A (SEQUENCE I.D. NO. 390) and GB-B (SEQUENCE I.D. NO. 394) do not share complete amino acid identity to each other and/or to HCV in other regions of HCV NS3S and NS5b. Specifically, over the 200 residue region of NS3S shown in FIG. 24A, GB-A (SEQUENCE I.D. NO. 390, residues 1252–1449) virus and HCV-1 (SEQ. ID. NO.395), GB-B (SEQUENCE I.D. NO. 394, residues 1212–1408) virus and HCV-1 (SEQUENCE I.D. NO.395), and GB-A (SEQUENCE I.D. NO. 390, residues 1252–1449) virus and GB-B (SEQUENCE I.D. NO. 394, residues 1212–1408) virus are 47%, 55% and 43.5% identical, respectively. In addition, over the 100 residue region of NS5b shown in FIG. 24B, GB-A (SEQUENCE I.D. NO. 390, residues 2644–2739) virus and HCV-1 (SEQUENCE I.D. NO. 395), GB-B (SEQUENCE I.D. NO. 394, residues 2513–1612) virus and HCV-1 (SEQUENCE I.D. NO.395), and GB-A (SEQUENCE I.D. NO. 390, residues 2644–2739) virus and GB-B (SEQUENCE I.D. NO. 394, residues 2599–2698) virus are 36%, 41% and 44% identical, respectively. Lower levels of homology are found in other putative nonstructural genes of GB-A (SEQUENCE I.D. NO. 390) and GB-B (SEQUENCE I.D. NO. 394) when compared to HCV. The overall level of homology of the putative nonstructural proteins of GB-A virus and GB-B virus compared with HCV sequences present in GenBank suggests that both GB-A (SEQUENCE I.D. NO. 163) and GB-B (SEQUENCE I.D. NO. 390) are derived from two separate members of the Flaviviridae. Flaviviruses contain a single genomic RNA molecule which code for one NTP-binding helicase domain and one RNA-dependent RNA polymerase domain. The presence of two contigs, each containing a putative RNA helicase domain and a putative RNA-dependent RNA polymerase is consistent with the presence of two HCV-like flaviviruses in the acute phase T-1053 plasma.

Example 10

PCR

In order to determine the sequence relatedness of HGBV to hepatitis C virus the following PCR-based experiment was performed. PCR primers based on the 5'-untranslated region (UTR) sequence of the HCV genome (J. H. Han, *PNAS* 88:1711–1715 [1991]), which are highly conserved in HCV isolates from a variety of geographic origins (Cha, T.-A., et al., *J. Clin. Microbiol.* 29:2528–2534 [1991]) were utilized in attempts to detect similar sequences in H205-infected tamarin T-1053 liver RNA. Total cellular RNA was extracted from the liver of infected tamarin T-1053 and from the liver of an uninfected tamarin (T-1040) as described in Example 8A. Thirty micrograms of each RNA sample was reverse transcribed and PCR amplified using a kit available from Perkin-Elmer essentially as described in the manufacturer's instructions. An antisense primer (primer 1) was used for the reverse transcriptase reaction and comprised bases 249–268 of the HCV 5'-UTR. Primer 1 and a primer comprising bases 13–46 of the HCV 5'-UTR (primer 2) were then used for PCR amplification of the intervening sequence. The conditions used for thermocycling were essentially as described by Cha et al., supra.

In order to increase the sensitivity of this assay for the detection of HCV 5'-UTR sequences in H205 infected tamarin T-1053, the above PCR reaction was subjected to a second amplification reacton which utilized "nested" PCR primers. These primers are derived from sequences found internal to the sequences of primers 1 and 2 above in the HCV 5'-UTR: Primer 3 comprised sequences from 47–69 and primer 4, an antisense primer, comprised bases 188–210 of the HCV 5'-UTR. In this "nested" PCR reaction, PCR products (2 μl out of a total of 100 μl reaction volume) from the first PCR reaction were used as the source of DNA template. The thermocycling parameters were essentially the same as described above except that the annealing temperature was 55° C. instead of 60° C. The resulting PCR products from the second PCR reaction were then analyzed for the expected DNA products by agarose gel electrophoresis and ethidium bromide staining. The expected DNA fragment sizes, based on the sequence of the HCV 5'UTR (Han et al., supra) is 253 bp for the product of the first PCR reaction and 163 bp for the product of the nested PCR reation. PCR products of the anticipated size were obtained in control experiments performed using 30 μg of total celluar RNA extracted form the liver of an HCV infected chimpanzee as described in Example 8A (data not shown), thus demonstrating that this experimental procedure was able to detect the 5-UTR of HCV. However, neither of the expected products were observed on the resulting ethidium bromide stained agarose gel when either T-1053 liver RNA or T-1040 liver RNA were used (data not shown). This inability to produce the predicted result may suggest that (i) the sequence of the 5'-UTR of the agent differs significantly from that of HCV such that the oligonucleotide primers used would not be able to anneal efficiently thereby dissallowing PCR amplification from occurring or (ii) the agent lacks a 5'-UTR. In either case it appears from these results that the nucleotide sequence of the agent is significantly different from that of HCV.

In addition, nucleic acids were isolated as in Example 7 from a chimpanzee plasma pool obtained during the acute phase of an experimental infection of HCV (G. Schlauder et al., *J. Clin. Microbiology* 29:2175–2179 [1991]). RT-PCR was performed as described in Example 7 using clone 16 primers (SEQUENCE I.D. NOS. 93 and 94). No bands of the expected size for these primers were detected by ethidium bromide staining or after hybridization to a clone 16 specific probe (data not shown). These results support the unrelatedness of clone 16 sequence (SEQUENCE I.D. NO. 26) to HCV.

Example 11

Reactivity of HGBV Infected Serum to Other Hepatits Viruses

Serum specimens were obtained prior to, and after, inoculation with HGBV using either the H205 inoculum (T-1048, T-1057, T-1061) or the T-1053 inoculum (T-1051) and tested for antibodies frequently detected following exposure to known hepatitis viruses. Specimens were tested for antibodies to hepatitis A virus (using the HAVAB assay, available from Abbott Laboratories, Abbott Park, Ill.), the core protein of hepatitis B core (using the Corzyme® test available from Abbott Laboratories, Abbott Park, Ill.), hepatitis E virus (HEV) (using the HEV EIA,-available from Abbott Laboratories, Abbott Park, Ill.) and hepatitis C virus (HCV) (utilizing HCV second generation test, available from Abbott Laboratories, Abbott Park, Ill.). These tests were performed according to the manufacturer's package inserts.

None of the tamarins tested positive for antibodies to HCV or to HEV either prior to or after HGBV inoculation (see TABLE 12). Therefore, HGBV infection does not elicit detectable antisera against HCV or HEV.

One of the tamarins (T-1061) was positive for antibodies to HAV prior to and after inoculation with HGBV, suggesting a previous exposure to HAV (TABLE 9, T-1061). However, the three remaining tamarins (T-1048, T-1057 and T-1051) show no HAV-specific antibodies after HGBV inoculation. Therefore, HGBV infection does not elicit an anti-HAV response. One of the tamarins (T-1048) was negative for antibodies to HBV core both prior to and after inoculation with HGBV. Two of the tamarins (T-1061 and T-1057) were positive prior to inoculation with HGBV. One of the tamarins (T-1051) was borderline positive for antibodies to HBV prior to inoculation, but was negative after inoculation. Based on these data, there is no evidence that infection with the HGBV agent induces an immune response to HBV core. Taken together, these data support that the HGBV agent is a unique viral agent, and is not related to any of the viral agents commonly associated with hepatitis in man.

Example 12

Western Blot Analysis of HGBV Infected Liver

As noted in Examples 1 and 2 above, elevated liver enzyme values are noted in tamarins inoculated with HGBV.

If HGBV is indeed a hepatotropic virus, it would be expected that viral protein(s) would be produced in infected liver cells, and that an immune response to those proteins would be generated. In this example, evidence is presented which suggests that a unique protein appears in livers obtained from HGBV-infected tamarins; this protein appears to be specifically recognized via Western blot utilizing tamarin serum obtained in the convalescent stage following infection with HGBV.

HGBV-infected tamarin livers and various control tamarin and chimpanzee livers were diced and homogenized in PBS (approximately 1 g liver to 5 ml) using a Omni-mixer homogenizer. The resulting suspension was clarified by centrifugation (10,000×g, 1 hour, 4° C.) and by microfiltration through 5 μm, 0.8 μm and 0.45 μm filters. The clarified homogenate was centrifuged under conditions pelleting all components of 100S or greater. Pellets (100S liver fractions) were taken up in a small volume of buffer and stored at −70° C.

SDS polyacrylamide gel electrophoresis (PAGE) was carried out using standard methods and reagents (Laemmli discontinuous gels). 100S liver fractions were diluted 1:20 in a sample buffer containing SDS and 2-mercaptoethanol and heated at 95° C. for 5 minutes. The proteins were electrophoresed through either 12% acrylamide or 4–15% acrylamide linear gradient gels, 7 cm×8 cm, at 200 volts for 30 to 45 minutes. Proteins were electro-transferred to nitrocellulose membranes using standard methods and reagents.

Western blots were developed using standard methods. Briefly, the nitrocellulose membrane was briefly rinsed in TBS/Tween and blocked overnight in TBS/CS (100 mM Tris, 150 mM NaCl, 10 mM EDTA, 0.18% Tween-20, 4.0% calf serum, pH 8.0) at 4° C. The nitrocellulose was placed in the Multi-screen apparatus and 600 μl of sera was placed in the channels and followed with a 2 hour room temperature and an overnight 4° C. incubation. After removing the membrane from the Multi-screen apparatus, it was washed 3 times, 5 minutes each, in 15 ml TBS/Tween (50 mM Tris, 150 mM NaCl, 0.05% Tween-20, pH 8.0). The membrane was incubated for 1 hour at room temperature in 15 ml goat anti-human:HRPO conjugate (0.2 μg/ml TBS/CS). After washing as before, the membrane was incubated in the TMB enzyme substrate solution, rinsed in water and dried.

Proteins isolated from T-1053 liver at sacrifice (12 days post-GB inoculation) and blotted as described above showed a unique immunogenic protein with an apparent molecular weight of approximately 50 to 80 kDa when reacted with T-1057 sera from 5, 6, 7, 9 or 11 weeks post-GB inoculation. The band was not present when reacted with T-1057 sera pre-inoculation or 3 weeks post-GB inoculation. This band did not appear in the lanes containing liver proteins obtained from an uninoculated tamarin (T-1040) when reacted with any of these T-1057 sera. In addition, a protein of the same size (50 to 80 kDa) was visible when the T-1053 liver proteins were reacted with other post-GB inoculation sera (T-1048 at 11 weeks post-GB inoculation and T-1051 at 8 weeks post-GB inoculation) but not when they were reacted with pre-inoculation sera from these same animals.

An additional Western blot experiment was performed to determine if this immunoreactive band would be detected in liver tissues from other GB-inoculated tamarins, or in liver tissues of chimpanzees infected either with HCV or HBV. In each case, the nitrocellulose strips containing the liver proteins were reacted with a pool of sera from T-1048 (5, 8, and 16 weeks post-GB inoculation) and T-1051 (8 and 12 weeks post-GB inoculation). All 5 sera in the pool were mixed in equal proportion. A reactive protein band of 50–80 kDa was seen with all of the tamarin liver samples obtained from GB inoculated tamarins (T-1038, T-1049, and T-1055 obtained at 14 days post-GB inoculation and T-1053 obtained at 12 days post-GB inoculation). This immunoreactive band was not detected in the liver preparations obtained from T-1040 (uninoculated) nor in any of the chimp liver preparations (CHAS-457 (pre-HCV inoculation), CHAS-457 (HCV+), CRAIG-454 (HCV+) and MUNA-376 (HBV+).

Taken together, these data demonstrate the existence of an immunogenic and antigenic protein with an apparent molecular weight of approximately 50 to 80 kDa specifically associated with HGBV-infected tamarin liver. The nature of this HGBV-associated protein (ie. whether it is viral encoded or of host origin) is currently under investigation. Regardless of the source of the HGBV-associated protein, these result are consistent with HGBV infection inducing an antibody response to an antigen which is present in HGBV-infected tamarin liver.

Example 13

CKS-based Expression and Detection of Immunogenic HGBV-A and HGBV-B Polypeptides
A. Cloning of HGBV-A and HGBV-B Sequences The cloning vectors pJO200, pJO201, and pJO202 allow the fusion of recombinant proteins to the CMP-KDO synthetase (CKS) protein. Each of these plasmids consists of the plasmid pBR322 with a modified lac promoter fused to a kdsB gene fragment (encoding the first 239 of the entire 248 amino acids of the *E. coli* CKS protein), and a synthetic linker fused to the end of the kdsB gene fragment. The synthetic linkers include: multiple restriction sites for insertion of genes, translational stop signals, and the trpA rho-independent transcriptional terminator. The unique restriction sites in this linker region include, from 5' to 3', EcoRI, SacI, KpnI, SmaI, BamHI, XbaI, PstI, SphI, and HindIII. Each plasmid allows for insertion in a different reading frame within the multiple cloning site. The CKS method of protein synthesis as well as CKS vectors are disclosed in U.S. Pat. No. 5,124,255, which enjoys common ownership and is incorporated herein by reference, and the use of CKS fusion proteins in assay formats and test kits is described in U.S. Ser. No. 07/903,043, which enjoys common ownership and is incorporated herein by reference.

The HGBV-A and HGBV-B sequences obtained from the walking experiments described in TABLES 9 and 10 (Example 9) were liberated from the appropriate pT7Blue T-vector clones using restriction enzymes listed in TABLES 13 and 14 (10 units, NEB), and purified from 1% low melting point agarose gels as described in Example 3B. Plasmids pJO200, pJO201, and pJO202 were digested with the same restriction enzymes (10 units, NEB) and dephosphorylated with bacterial alkaline phosphatase (GIBCO BRL, Grand Island, N.Y.). Each purified HGBV fragment was ligated into the digested, dephosphorylated pJO200, pJO201, and pJO202 and transformed into *E. coli* XL1 Blue as described in Example 3B. Standard miniprep analyses confirmed the successful construction of the CKS/HGBV expression vectors.

Two additional PCR products were generated specifically for expression. The 2 products, designated 4.1 and 4.2, were predicted to encode the HGBV-B and HGBV-A core regions, respectively (see FIG. 22). PCR product 4.1 was generated using primers coreB-s and coreB-a1 (SEQUENCE I.D. NOS. 702 and 703) and PCR product 4.2 was generated using primers coreA-s and 2.2.1' (SEQUENCE I.D. NOS. 704 and 138), as described in Example 9. The 4.1 sense and antisense primers had EcoRI and BamHI restriction sites, respectively, designed into the ends. The 4.1 PCR product was digested, gel isolated, and ligated to pJO200, pJO201, and pJO202 as described above. The sense primer for the 4.2 PCR product had an EcoRI restriction site designed into the end, but the antisense primer did not have a restriction site. Thus, the product was cut with EcoRI, gel isolated, and ligated to pJO200, pJO201, and pJO202 which had been digested with BamHI, end-filled with the Klenow fragment of DNA polymerase and dNTPs, digested with EcoRI, and dephosphorylated with bacterial alkaline phosphatase as described in the art.

B. Expression of HGBV-A and HGBV-B Sequences

E. coli XL1 Blue cultures containing the CKS/HGBV expression vectors were grown at 37° C. with shaking in media containing 32 gm/L tryptone, 20 gm/L yeast extract, 5 gm/L NaCl, pH7.4, plus 100 mg/L ampicillin and 3 mM glucose. When the cultures reached an OD600 of between 1.0 and 2.0, IPTG was added to a final concentration of 1 mM to induce expression from the modified lac promoter. Cultures were allowed to grow at 37° C. with shaking for an additional 3 hours, and were then harvested. The cell pellets were resuspended to an OD600 of 10 in SDS/PAGE loading buffer (62.5 mM Tris pH6.8, 2% SDS, 10% glycerol, 5% 2-mercaptoethanol, and 0.1 mg/ml bromophenol blue), and boiled for 5 minutes. Aliquots of the prepared whole cell lysates were run on a 10% SDS-polyacrylamide gel, stained in a solution of 0.2% Coomassie blue dye in 40% methanol/10% acetic acid and destained in 16.5% methanol/5% acetic acid until a clear background was obtained.

The whole cell lysates were run on a second 10% SDS-polyacrylamide gel, and electrophoretically transferred to nitrocellulose for immunoblotting. The nitrocellulose sheet containing the transferred proteins was incubated in blocking solution (5% Carnation nonfat dry milk in Tris-buffered saline) for 30 minutes at room temperature followed by incubation for 1 hour at room temperature in goat anti-CKS sera which had been preblocked against *E. coli* cell lysate then diluted 1:1000 in blocking solution. The nitrocellulose sheet was washed two times with Tris-buffered saline (TBS), then incubated for 1 hour at room temperature with alkaline phosphatase-conjugated rabbit anti-goat IgG, diluted 1:1000 in blocking solution. The nitrocellulose was washed two times with TBS and the color was developed in TBS containing nitroblue tetrazolium and 5-bromo-4-chloro-3-indolyl phosphate. The appropriate reading frame for each fragment was identified based on expression of an immunoreactive CKS fusion protein of the correct predicted size, and further confirmed by DNA sequencing across the vector-insert junction.

After determining the appropriate reading frame for each of the fragments, samples from cultures containing the appropriate constructs were analyzed by SDS-polyacrylamide gel electrophoresis and Western blot. FIG. 25A shows 2 Coomassie-stained 10% SDS-polyacrylamide gels containing the CKS fusion protein whole cell lysates. Lanes 1 and 16 contain molecular weight standards with the sizes in kilodaltons shown on the left. The loading order on gel 1 (HGBV-A samples) is as follows: lane 2, clone 1.17 prior to induction; lanes 3–15, clone 4.2, clone 1.17, clone 1.8, clone 1.2, clone 1.18 (SEQUENCE I.D. NO. 387), clone 1.19, clone 1.20, clone 1.21, clone 1.22 (SEQUENCE I.D. NO. 387), clone 2.12, clone 1.5, clone 1.23, and clone 2.18 respectively, all after 3 hours of induction. The loading order on gel 2 (HGBV-B samples) is as follows: lane 17, clone 4.1 prior to induction; lanes 18–29, clone 4.1, clone 1.15, clone 1.14, clone 2.8, clone 1.13, clone 1.12, clone 2.1, clone 1.7, clone 1.3, clone 1.4, clone 1.16, and clone 2.12 respectively, all after 3 hours of induction. These proteins were run on 2 additional 10% gels, in the same loading order, and transferred to nitrocellulose as described above. The samples were analyzed by Western blot using a pool of sera from 2 convalescent tamarins, T-1048 and T-1051, as follows: The nitrocellulose sheets containing the samples were incubated for 30 minutes in blocking solution, followed by transfer to blocking solution containing 10% *E. coli* lysate, 6 mg/ml XL1-Blue/CKS lysate, and a 1:100 dilution of the pooled convalescent tamarin sera described in TABLE 6 (Example 4). After overnight incubation at room temperature, the nitrocellulose sheets were washed two times in TBS and then incubated for 1 hour at room temperature in HRPO-conjugated goat anti-human IgG, diluted 1:500 in blocking solution. The nitrocellulose sheets were washed two times in TBS and the color was developed in TBS containing 2 mg/ml 4-chloro-1-napthol, 0.02% hydrogen peroxide and 17% methanol. As shown in FIG. 25B, three HGBV-B proteins demonstrated immunoreactivity with the pooled tamarin sera; CKS fusions of clones 1.4, 1.7, and 4.1. Clone 1.7 contains the sequence encoding an HGBV-B immunogenic region (SEQUENCE I.D. NO. 604) and clone 1.4 contains the sequence encoding two HGBV-B immunogenic regions (SEQ. ID. NOS. 12, 13 and 18), identified by immunoscreening of a cDNA library (Example 4) using the same pool of convalescent tamarin sera.

The samples described in the previous paragraph were also analyzed by Western blot as above using a 1:100 dilution of convalescent serum obtained approximately three weeks following the onset of acute hepatitis from the surgeon GB. The reactivities of the fusion proteins from HGBV-A and HGBV-B with this serum are indicated in TABLES 13 and 14. Only one HGBV-B protein (2.1) showed reactivity with this serum, and the reactivity was quite weak, while two HGBV-A proteins (1.22 [SEQUENCE I.D. NO. 387] and 2.17) exhibited strong reactivity with this serum. These two HGBV-A proteins overlap by 40 amino acids, so this may reflect reactivity with one epitope or more than one epitope. These two HGBV-A proteins were chosen for use in ELISA assays as described in Example 16. It is of interest to note that although tamarins infected with the eleventh passage GB material (H205 GB pass 11) demonstrate an immune response to several HGBV-B epitopes but no HGBV-A epitopes, serum from the original GB source demonstrates significant reactivity with at least one HGBV-A epitope. This suggests that HGBV-A may have been the causative agent of hepatitis in the surgeon GB.

Four additional human sera which had indicated the presence of antibodies to one or more of the CKS/HGBV-A or CKS/HGBV-B fusion proteins by the 1.4, 1.7, or 2.17 ELISAS (see Examples 15 and 16) were chosen for Western blot analysis. Three of these sera (G1-41, G1-14 and G1-31) are from the West African "at risk" population and the fourth (341C) is from a nonA-E hepatitis (Egypt) sample (see Example 15 for detailed description of these populations). Additional 10% SDS-polyacrylamide gels containing the whole cell lysates from some of the CKS fusion proteins discussed above were run and transferred to nitrocellulose as described previously. Each of these blots was preblocked as described, then incubated overnight with one of the human serum sample diluted 1:100 in blocking buffer containing 10% *E. coli* lysate and 6 mg/ml XL1-Blue/CKS lysate. The blots were washed two times in TBS, then reacted with HRPO-conjugated goat anti-human IgG and developed as indicated above.

The CKS/HGBV-B proteins were analyzed with two of these sera, G1-41 and G1-14, and the reactivities are indicated in TABLE 13. In addition to the three proteins which showed reactivity with the tamarin sera, two additional proteins (1.16 and 2.1) showed reactivity with one or the other of the two human sera. The CKS/HGBV-A proteins were analyzed with all four of these human sera and the reactivities are indicated in TABLE 14. In addition to the two proteins which showed reactivity with GB serum, three additional proteins (1.5, 1.18, and 1.19) showed reactivity with one or more of the human sera. Two of these (1.5 and 1.18) were chosen for use in ELISA assays as described in Example 16. It is of particular interest to note that the G1-31 serum, which shows reactivity by Western blot and/or ELISA (Examples 15 and 16) with two HGBV-A proteins (1.18 and 2.17) and one HGBV-B protein (1.7), is the serum from which the GB-C sequence (SEQUENCE I.D. No. 667, residues 2274–2640) was isolated (Example 17).

TABLE 13

HGBV-B Samples

| PCR product[a] | Restriction digest[b] | Reactivity with T1048 + T1051 sera | Reactivity with GB sera | Reactivity with human G1-41 sera | Reactivity with human G1-14 sera |
| --- | --- | --- | --- | --- | --- |
| 1.3 | EcoRI, PstI | − | − | − | − |
| 1.4 | EcoRI, XbaI | + | − | + | + |
| 1.7 | EcoRI, HindIII | + | − | + | − |
| 1.12 | KpnI, PstI | − | − | − | − |
| 1.13 | EcoRI, XbaI | − | − | − | − |
| 1.14 | BamHI, HindIII | − | − | − | − |
| 1.15 | EcoRI, PstI | − | − | − | − |
| 1.16 | EcoRI, XbaI | − | − | + | − |
| 2.1 | EcoRI, HindIII | − | +/− | − | + |
| 2.8 | EcoRI, XbaI | − | − | − | − |
| 2.12 | KpnI, PstI | − | − | − | − |
| 4.1 | EcoRI, BamHI | + | − | − | − |

[a]PCR product is as indicated in TABLE 9, TABLE 10, or Example 13.
[b]Restriction digests used to liberate the PCR fragment from pT7Blue T-vector or for direct digestion of 4.1 PCR product.

Example 14

Epitope Mapping of Immunoreactive HGBV-A and HGBV-B Proteins

A. Epitope Mapping of HGBV-B Protein 1.7

Overlapping subclones within the HGBV-B immunogenic protein 1.7 were generated by RT-PCR from T1053 serum as described in Example 7 in order to determine the location of the immunogenic region or regions. Each PCR primer had six extra bases on the 5' end to facilitate restriction enzyme digestion, followed by either an EcoRI site (sense primers) or a HindIII site (antisense primers). In addition, each antisense primer contained a stop codon just after the coding region. After digestion, each fragment was cloned into EcoRI/HindIII-digested pJO201 as described in Example 13. The CKS fusion proteins were expressed and analyzed by Western blot with tamarin T1048/T1051 sera as described in Example 13. Five overlapping clones, designated 1.7-1 through 1.7-5, were generated. The clones encoded regions of the 1.7 protein ranging in size from 104 to 110 amino acids. The PCR primers used to generate each clone, the sizes of the encoded polypeptides, the location within the 1.7 sequence and the reactivity with tamarin T1048/T1051 sera are shown in TABLE 15. Two further overlapping clones were generated which encompassed the immunogenic region (SEQUENCE I.D. NO. 672) identified by immunoscreening of a cDNA library (Example 4). Each of these clones, designated 1.7-6 and 1.7-7, encoded polypeptides of 75 amino acids. The PCR primers, sizes of encoded polypeptides, location within the 1.7 sequence and reactivity with tamarin T1048/T1051 sera are shown in TABLE 15. Two immunogenic regions were identified within the 507 amino acid long 1.7 protein; one near the N-terminus within residues 1–105, and another near the middle of the protein, encompassing residues 185 to 410. It remains to be determined whether there is a single epitope or multiple epitopes within each of these regions.

B. Epitope Mapping of HGBV-B Protein 1.4

Overlapping subclones within the HGBV-B immunogenic protein 1.4 were generated by RT-PCR from T1053 serum as above in order to determine the location of the immunoreactive region or regions. Each PCR primer had six extra bases on the 5' end to facilitate restriction enzyme digestion, followed by either an EcoRI site (sense primers) or a BamHI site (antisense primers). In addition, each antisense primer contained a stop codon just after the coding region. After digestion, each fragment was cloned into EcoRI/BamHI-digested pJO201 as described in Example 13. The CKS fusion proteins were expressed and analyzed by Western blot with tamarin T1048/T1051 sera as described in Example 13. Four overlapping clones, designated 1.4-1 through 1.4-4, were generated. The clones encoded regions of the 1.4 protein ranging in size from 137 to 138 amino acids. The PCR primers used to generate each clone, the sizes of the encoded polypeptides, the location within the 1.4 sequence and the reactivity with tamarin T1048/T1051 sera are shown in TABLE 15. Two further overlapping clones were generated which encompassed an immunogenic region identified by immunoscreening of a cDNA library (Example 4). Each of these clones, designated 1.4-5 and 1.4-6, encoded polypeptides of 75 amino acids. The PCR primers, sizes of encoded polypeptides, location within the 1.4 sequence and reactivity with tamarin T1048/T1051 sera are shown in TABLE 15. A 265 amino acid sequence was identified as being the immunogenic region within the 522 amino acid long 1.4 protein, encompassing residues 129 to 393. It is likely that there are at least two epitopes within this region, since library immunoscreening (Example 4) identified two immunogenic non-contiguous clones within this sequence.

C. Epitope Mapping of HGBV-A Proteins 1.22 (SEQUENCE I.D. NO. 387) and 2.17

The HGBV-A proteins 1.22 (SEQUENCE I.D. NO. 387) and 2.17 (SEQUENCE I.D. NO. 607) both showed immunoreactivity with GB serum by Western blot (Example 13). Since these two proteins overlap by 40 amino acids, the observed immunoreactivity may have resulted from the presence of one epitope or more than one epitope. The complete 1.22/2.17 sequence is 641 amino acids long. Overlapping subclones within this region were generated by RT-PCR from T1053 serum as above in order to determine the location of the immunogenic region or regions. Each PCR primer had six extra bases on the 5' end to facilitate restriction enzyme digestion, followed by either an EcoRI site (sense primers) or a BamHI site (antisense primers) for 1.22/2.17-2 through 1.22/2.17-6. However, since clone 1.22/2.17-1 had an internal EcoRI site, a BamHI site was used in the sense primer and a HindIII site was used in the antisense primer. In addition, each antisense primer contained a stop codon just after the coding region. After digestion, each fragment was cloned into EcoRI/BamHI-digested (or BamHI/HindIII-digested for 1.22/2.17-1) pJO201 as described in Example 13. The CKS fusion proteins were expressed and analyzed by Western blot with GB serum as described in Example 13. The clones encoded regions of 1.22/2.17 ranging in size from 115 to 116 amino acids. The PCR primers used to generate each clone, the sizes of the encoded polypeptides, the location within the HGBV-A polypeptide sequence and the reactivity with GB serum are shown in TABLE 15. The immunogenic region was narrowed down to a 220 amino acid long region in the middle of the 1.22/2.17 protein. This encompassed the 40 amino acid region of overlap between 1.22 and 2.17, and thus the immunoreactivity seen with the two proteins individually may have been due to a shared epitope or to multiple epitopes.

of sequential washes to to eliminate the majority of non-recombinant *E. coli* proteins. The washes used in this protocol included distilled water, 5% Triton X-100 and 50 mM Tris (pH 8.5). The resulting pellets were solubilized in the presence of sodium dodecyl sulfate (SDS). After determining protein concentration, 2-mercaptoethanol was added and the mixtures were subjected to gel filtration column chromatography, with Sephacryl S300 resin used to size and separate the various proteins. Fractions were collected and analyzed by SDS-polyacrylamide gel electrophoresis (SDS-PAGE) The electrophoretically separated proteins were then stained with Coomassie Brilliant Blue R250 and examined for the presence of a protein having a molecular weight of approximately 75 kD (CKS-1.7/SEQUENCE I.D. NO. 604), 80 kD (CKS-1.4/SEQUENCE I.D. NO. 605), 42 kD (CKS-4.1/SEQUENCE I.D. NO. 606). Fractions containing the protein of interest were pooled and re-examined by SDS-PAGE.

The immunogenicity and structural integrity of the pooled fractions containing the purified antigen were determined by immunoblot following electrotransfer to nitrocellulose as described in Example 13. In the absence of a qualified positive control, the recombinant proteins were identified by

TABLE 15

| CLONE | SIZE OF ENCODED POLYPEPTIDE | PRIMER SET | T1048/T1051 REACTIVITY | RESIDUES IN SEQ ID NO. 120 |
| --- | --- | --- | --- | --- |
| 1.7-1 | 105 aa | SEQ ID #609/SEQ ID #610 | + | 1–105 |
| 1.7-2 | 109 aa | SEQ ID #611/SEQ ID #612 | − | 98–206 |
| 1.7-3 | 110 aa | SEQ ID #613/SEQ ID #614 | + | 199–308 |
| 1.7-4 | 110 aa | SEQ ID #615/SEQ ID #616 | +/− | 301–410 |
| 1.7-5 | 104 aa | SEQ ID #617/SEQ ID #618 | − | 403–507 |
| 1.7-6 | 75 aa | SEQ ID #619/SEQ ID #620 | + | 185–259 |
| 1.7-7 | 75 aa | SEQ ID #621/SEQ ID #622 | + | 251–325 |

| CLONE | SIZE OF ENCODED POLYPEPTIDE | PRIMER SET | T1048/T1051 REACTIVITY | RESIDUES IN SEQ ID NO. 119 |
| --- | --- | --- | --- | --- |
| 1.4-1 | 137 aa | SEQ ID #623/SEQ ID #624 | − | 1–137 |
| 1.4-2 | 137 aa | SEQ ID #625/SEQ ID #626 | + | 129–265 |
| 1.4-3 | 137 aa | SEQ ID #627/SEQ ID #628 | + | 257–393 |
| 1.4-4 | 138 aa | SEQ ID #629/SEQ ID #630 | − | 385–522 |
| 1.4-5 | 75 aa | SEQ ID #631/SEQ ID #632 | + | 138–212 |
| 1.4-6 | 75 aa | SEQ ID #633/SEQ ID #634 | + | 204–278 |

| CLONE | SIZE OF ENCODED POLYPEPTIDE | PRIMER SET | GB SERUM REACTIVITY | RESIDUES IN SEQ ID NO. 390 |
| --- | --- | --- | --- | --- |
| 1.22/2.17-1 | 115 aa | SEQ ID #635/SEQ ID #636 | − | 1862–1976 |
| 1.22/2.17-2 | 115 aa | SEQ ID #637/SEQ ID #638 | − | 1967–2081 |
| 1.22/2.17-3 | 115 aa | SEQ ID #639/SEQ ID #640 | + | 2072–2186 |
| 1.22/2.17-4 | 115 aa | SEQ ID #641/SEQ ID #642 | + | 2177–2291 |
| 1.22/2.17-5 | 115 aa | SEQ ID #643/SEQ ID #644 | − | 2282–2396 |
| 1.22/2.17-6 | 116 aa | SEQ ID #645/SEQ ID #646 | − | 2387–2505 |

Example 15

Serological Studies HGBV-B

A. Recombinant Protein Purification Protocol

Bacterial cell cultures expressing the CKS fusion proteins were frozen and stored at −70° C. The bacterial cells from each of the three constructs were thawed and disrupted by treating with lysozyme and DNAse, followed by sonication in the presence of phenylmethanesulfonyl fluoride and other protease inhibitors to produce mixtures of the individual recombinant antigen and *E. coli* proteins. Individually for each of the three cultures, the insoluble recombinant antigen was concentrated by centrifugation and subjected to a series their reactivity with a monoclonal antibody directed against the CKS portion of each fusion protein. When the CKS-1.7 protein (SEQUENCE I.D. NO. 604) was examined by Western blot, using the anti-CKS monoclonal antibody to detect the recombinant antigen, a single band at approximately 75 kD was observed. This corresponds to the expected size of the CKS-1.7 protein (SEQUENCE I.D. NO. 604). For the CKS-1.4 protein (SEQUENCE I.D. NO. 605), the anti-CKS monoclonal antibody detects a quadruplet banding pattern between 60 and 70 kD. These observed bands are smaller than the expected size of the full length protein and probably represent truncation products. When the CKS-4.1 protein (SEQUENCE I.D. NO. 52) was examined by Western blot, the anti-CKS monoclonal antibody detected the recombinant antigen as a single band at approximately 42 kD. This corresponds to the expected size of the CKS-4.1 protein (SEQUENCE I.D. NO. 606).

B. Polystyrene Bead Coating Procedure

The proteins were dialyzed and evaluated for their antigenicity on polystyrene coated beads as described below. Separate enzyme-linked immunosorbent assays (ELISA's) were developed for detecting antibodies to HGBV using each of the three purified HGBV recombinant proteins (CKS-1.7 (SEQUENCE I.D. NO. 604); CKS-1.4 (SEQUENCE I.D. NO. 605); and the CKS-4.1 protein (SEQUENCE I.D. NO. 606). The ELISA's developed with these proteins are referred to as the 1.7 ELISA (utilizing the CKS-1.7 (SEQUENCE I.D. NO. 604) recombinant protein), the 1.4 ELISA (utilizing the CKS-1.4 (SEQUENCE I.D. NO. 605) recombinant protein), the 4.1 ELISA (utilizing the CKS-4.1 [SEQUENCE I.D. NO. 606]) recombinant protein. In the first study, one-quarter inch polystyrene beads were coated with various concentrations with each of the purified proteins (approximately 60 beads per lot) and evaluated in an ELISA test (described below) using serum from an uninoculated tamarin as a negative control and convalescent sera from an inoculated tamarin as a positive control. Additional controls included the a pool of human serum from individuals testing negative for various hepatitis viruses. An additional positive control consisted of monoclonal antibodies to the CKS protein to monitor the efficiency of bead coating. The bead coating conditions providing the highest ratio of positive control signal to negative control signal were selected for scaling up the bead coating process. For each of the four ELISA's at least two lots of 1,000 beads were produced and utilized for serological studies.

Briefly, polystyrene beads were coated with the purified proteins by adding the washed beads to a scintillation vial and immersing the beads (approximately 0.233 ml per bead) in a buffered solution containing the recombinant antigen. Several different concentrations of each of the recombinant antigens were evaluated along with several different buffers prepared at pHs ranging from pH 5.0 to pH 9.5. The vials were then placed on a rotating device in a 40° C. incubator for 2 hours after which the fluids were aspirated and the beads were washed three times in phosphate buffered saline (PBS), pH 6.8. The beads were then treated with 0.1% Triton X-100 for 1 hour at 40° C. and washed three times in PBS. Next, the beads were overcoated with 5% bovine serum albumin and incubated at 40° C. for 1 hour with agitation. After additional washing steps with PBS, the beads were overcoated with 5% sucrose for 20 minutes at room temperature and the fluids were aspirated. Finally, the beads were air dried and then utilized for developing ELISA's for detection of antibodies to HGBV.

C. ELISA Protocol for Detection of Antibodies to HGBV

An indirect assay format was utilized for the ELISA's. Briefly, sera or plasma was diluted in specimen diluent and reacted with the antigen coated solid phase. After a washing step, the beads were reacted with horseradish-peroxidase (HRPO) labeled antibodies directed against human immunoglobulins to detect tamarin or human antibodies bound to the solid phase. Specimens which produced signals above a cutoff value were considered reactive. Additional details pertaining to the ELISA's are described below.

The format for the ELISA's entails contacting the antigen-coated solid phase with tamarin serum pre-diluted in specimen diluent (buffered solution containing animal sera and non-ionic detergents). This specimen diluent was formulated to reduce background signals obtained from non-specific binding of immunoglobulins to the solid phase while enhancing the binding of specific antibodies to the antigen-coated solid phase. Specifically, 10 μl of tamarin serum was diluted in 150 μl of specimen diluent and vortexed. Ten microliters of this pre-diluted specimen was then added to the well of a reaction tray, followed by the addition of 200 μl of specimen diluent and an antigen coated polystyrene bead. The reaction tray was then incubated in a Dynamic Incubator (Abbott Laboratories) set for constant agitation at room temperature. After a 1 hour incubation, the fluids were aspirated, and the wells containing the beads were washed three times in distilled water (5 ml per wash). Next, 200 μl of HRPO-labeled goat anti-human immunoglobulins diluted in a conjugate diluent (buffered solution containing animal sera and non-ionic detergents) was added to each well and the reaction tray was incubated again as above for 1 hour. The fluids were aspirated and the wells containing the beads were washed three times in distilled water as above. The beads containing antigen and bound immunoglobulins were removed from the wells, each was placed in a test tube and reacted with 300 μL of a solution of 0.3% o-phenylenediamine-2 HCl in 0.1 M citrate buffer (pH 5.5) with 0.02% $H_2O_2$. After 30 minutes at room temperature, the reaction was terminated by the addition of 1 N $H_2SO_4$. The absorbance at 492 nm was read on a spectrophotometer. The color produced was directly proportional to the amount of antibody present in the test sample.

For each group of specimens, a preliminary cutoff value was set to separate those specimens which presumably contain antibodies to the HGBV epitope from those which did not.

D. Detection of HGBV Derived RNA in Serum from Infected Individuals

In order to correlate serological data obtained for 1.7 and 1.4 ELISA's with the presence of HGBV RNA in tamarin serum or in human serum/plasma, RT-PCR was performed as described in Example 7 of U.S. Ser. No. 08/283,314, previously incorporated herein by reference utilizing oligonucleotides derived from HGBV cloned sequences, at a final concentration of 0.5 μM for clone 4 (as described in Example 7) derived from the HGBV-B genome and for clone 16, derived from the HGBV-A genome.

E. Tamarin Serological Profiles

Serum was obtained from tamarins housed at LEMSIP on a weekly basis and tested for liver enzyme levels; the remaining volume from these specimens was sent to Abbott Laboratories for further studies.

1. ELISA Results on Tamarins (Initial Infectivity Studies)

Figure 2:
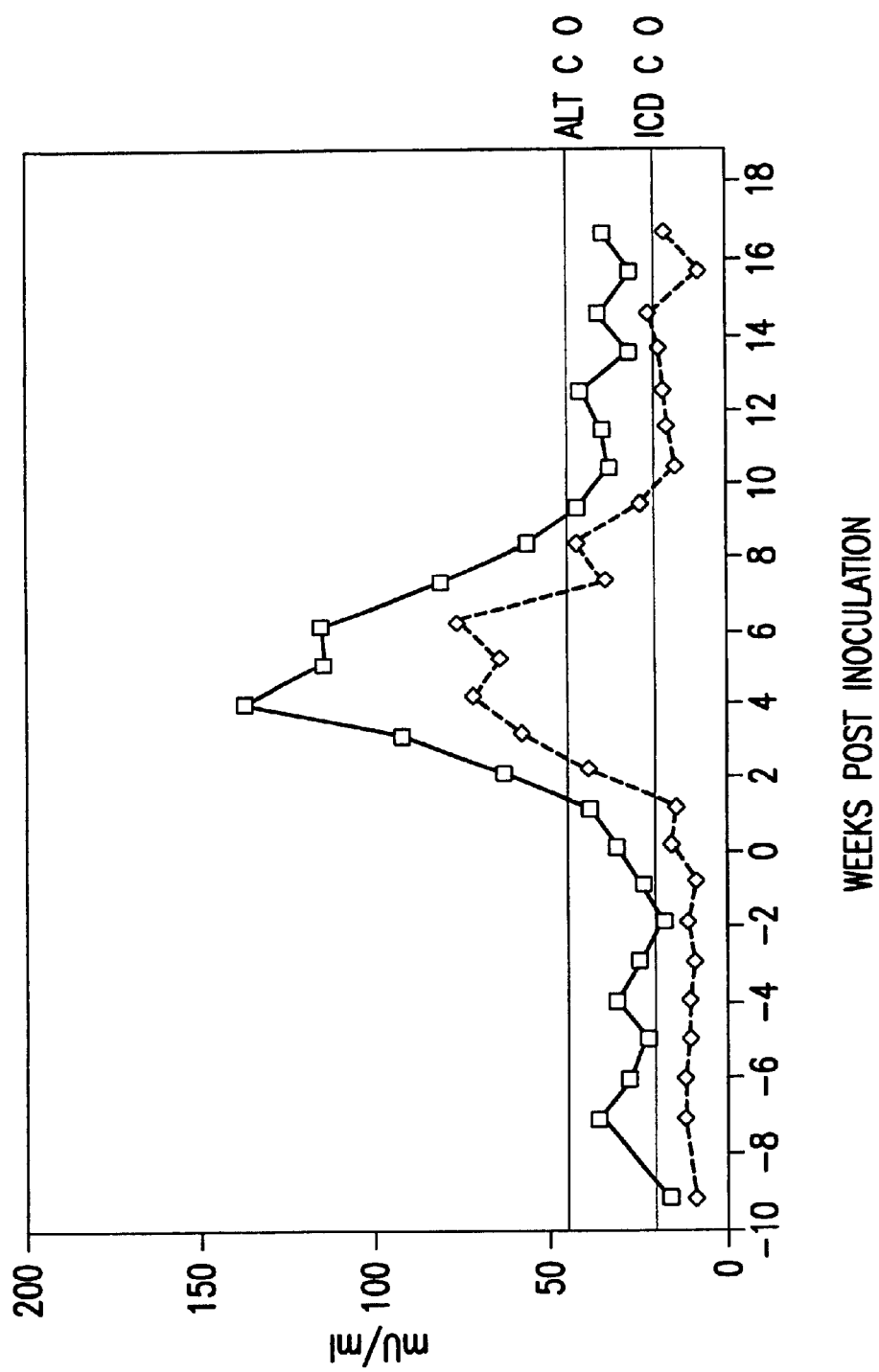

Four tamarins (T-1053, T-1048, T-1057 and T-1061) were inoculated with GB serum (designated as H205 GB passage 11). Elevated liver enzymes were noted in Tamarin T-1053 during the first week post-inoculation (PI): this tamarin was euthanized on day 12 PI. Tamarins T-1048, T-1057 and T-1061 exhibited elevated liver enzyme values within two weeks following their inoculation; these elevated values persisted until 8–9 weeks PI (FIGS. 2–4) before returning to pre-inoculation levels. On week 14 PI, these three tamarins were re-challenged with 0.10 ml of neat serum obtained from tamarin T-1053 (which was shown to be infectious—Example 2).

Figure 3:
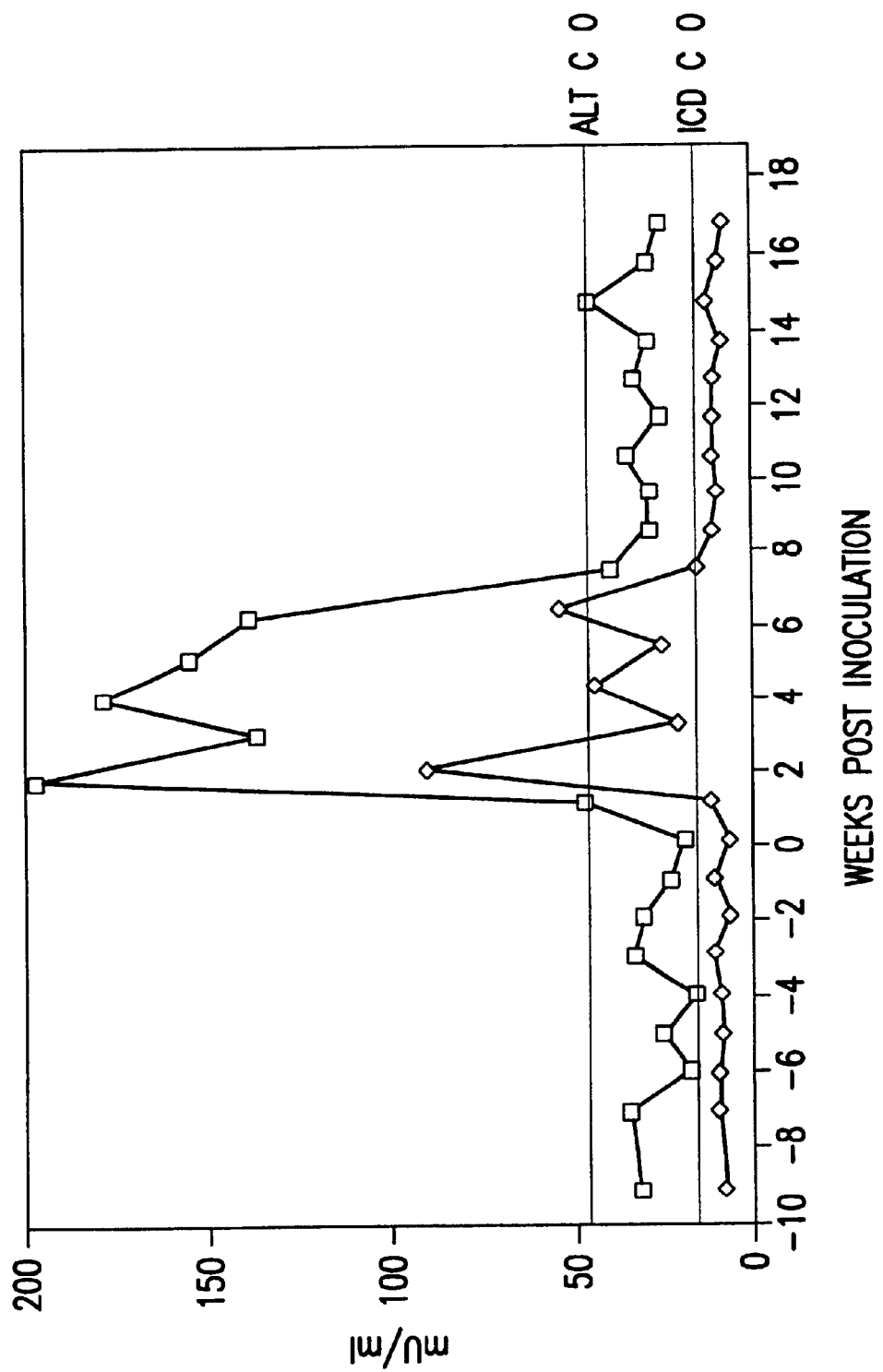
Figure 4:
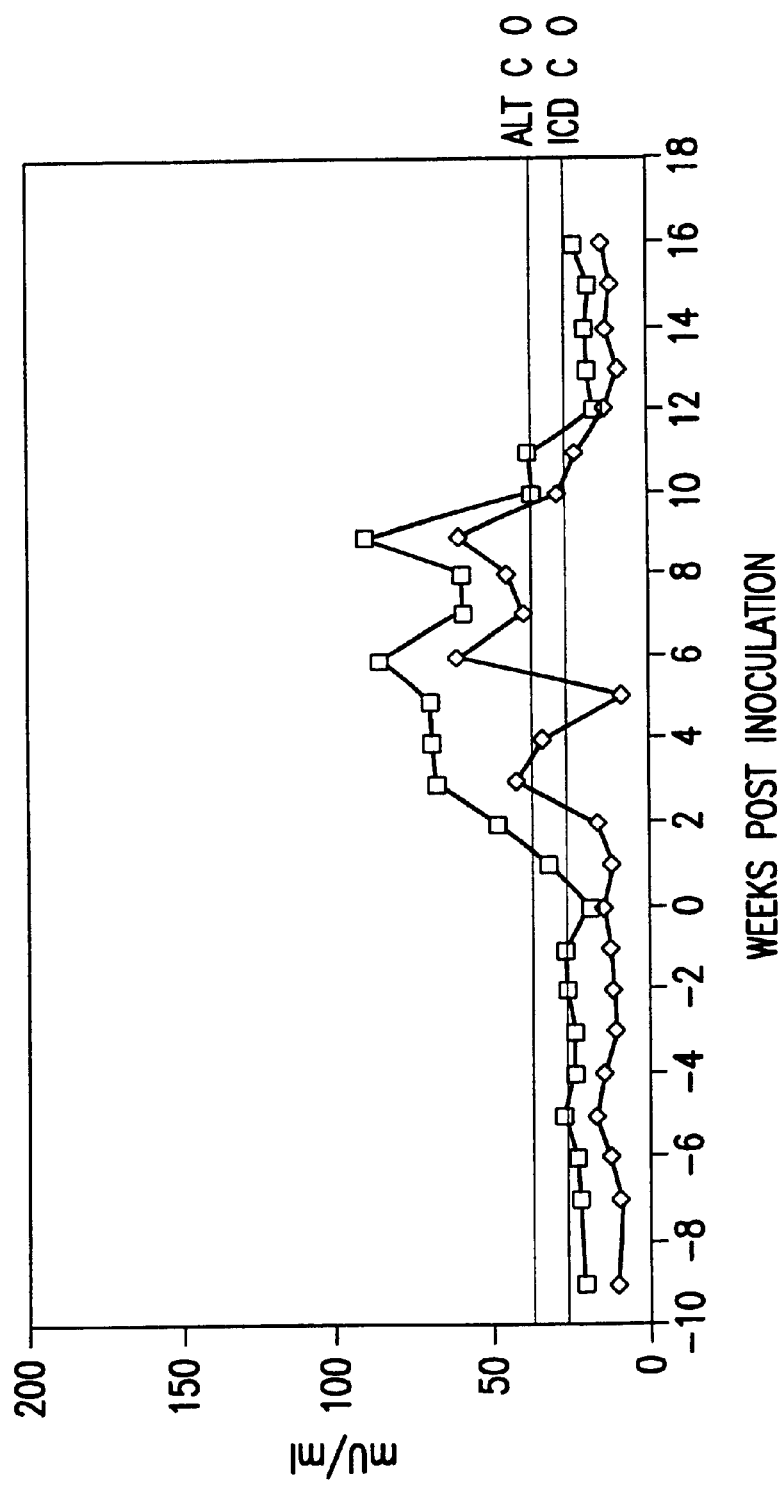
Figure 5:
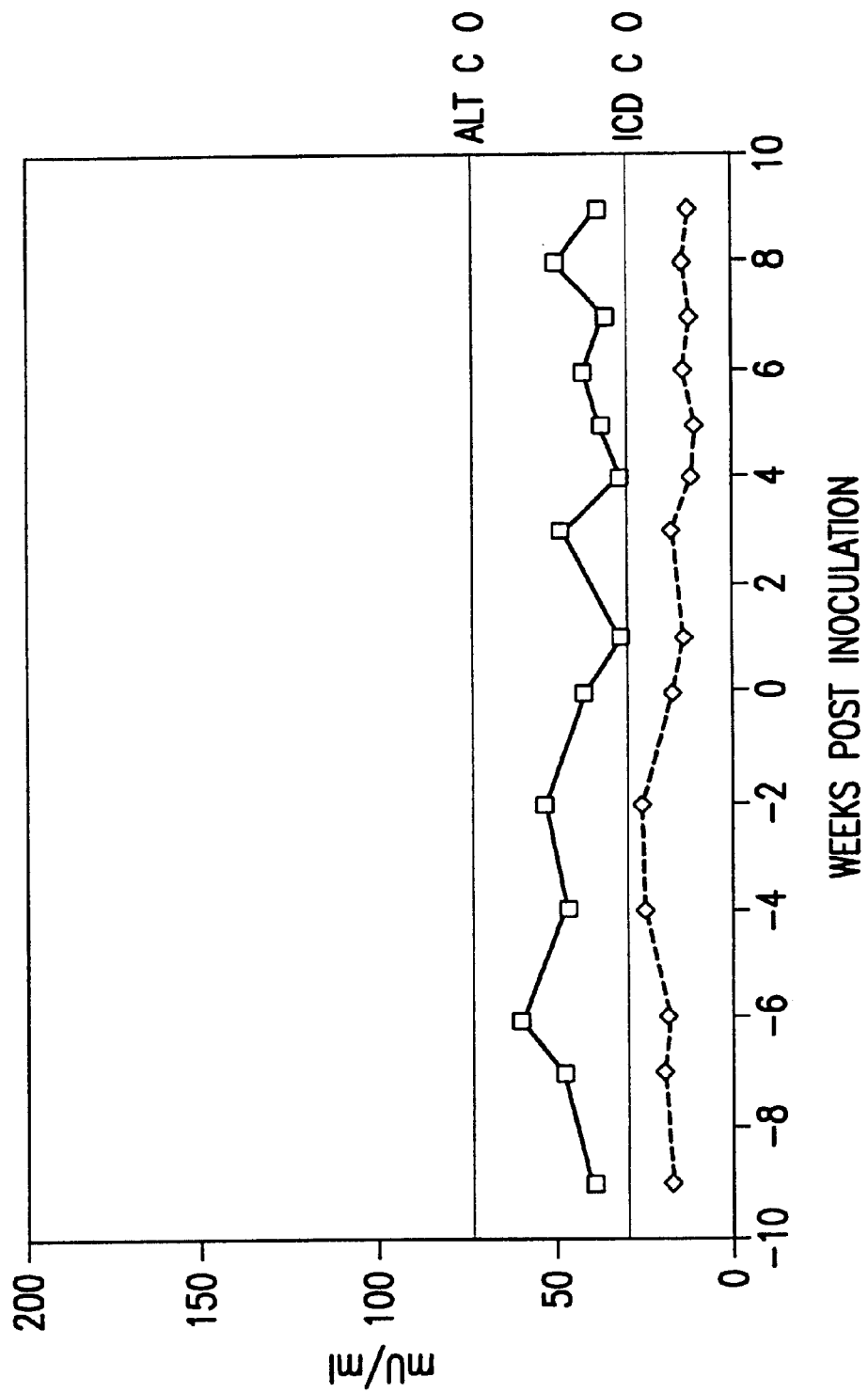
Figure 6:
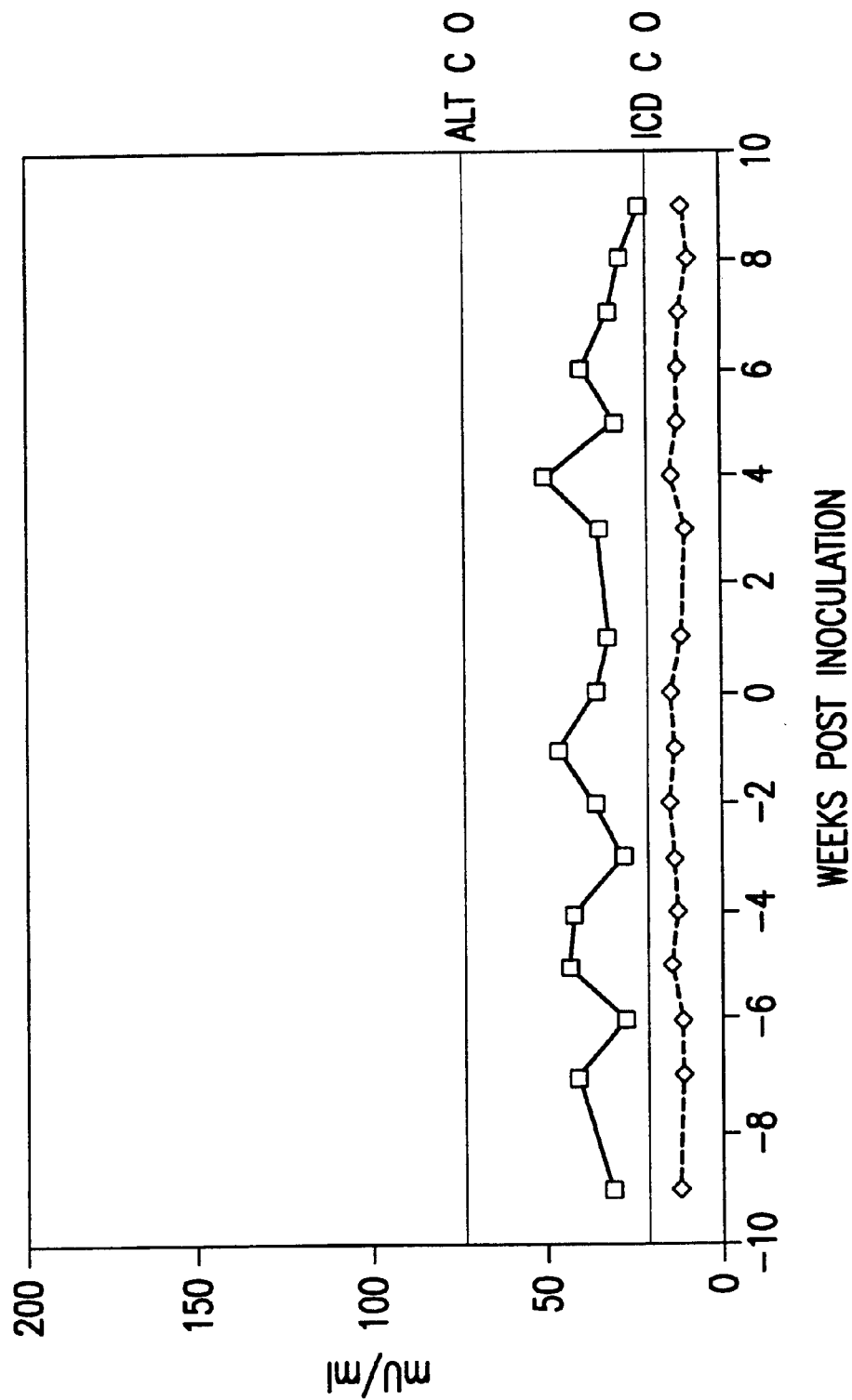

Sera from three convalescing tamarins (T-1048, T-1057 and T-1061) were tested for antibodies to the CKS-1.7 (SEQUENCE I.D. NO. 604) recombinant protein, the CKS-1.4 (SEQUENCE I.D. NO. 605) recombinant protein, and the CKS 4.1 (SEQUENCE I.D. NO. 606) recombinant protein, using separate ELISA's (FIGS. 3, 4 and 5). Specific antibodies to 1.7 (SEQUENCE I.D. NO. 604), 1.4 (SEQUENCE I.D. NO. 605), 4.1 (SEQUENCE I.D. NO. 606, or 1.5 (SEQUENCE I.D. NO. 608) recombinant proteins were not detected in any of the pre-inoculation specimens.

Figure 26:
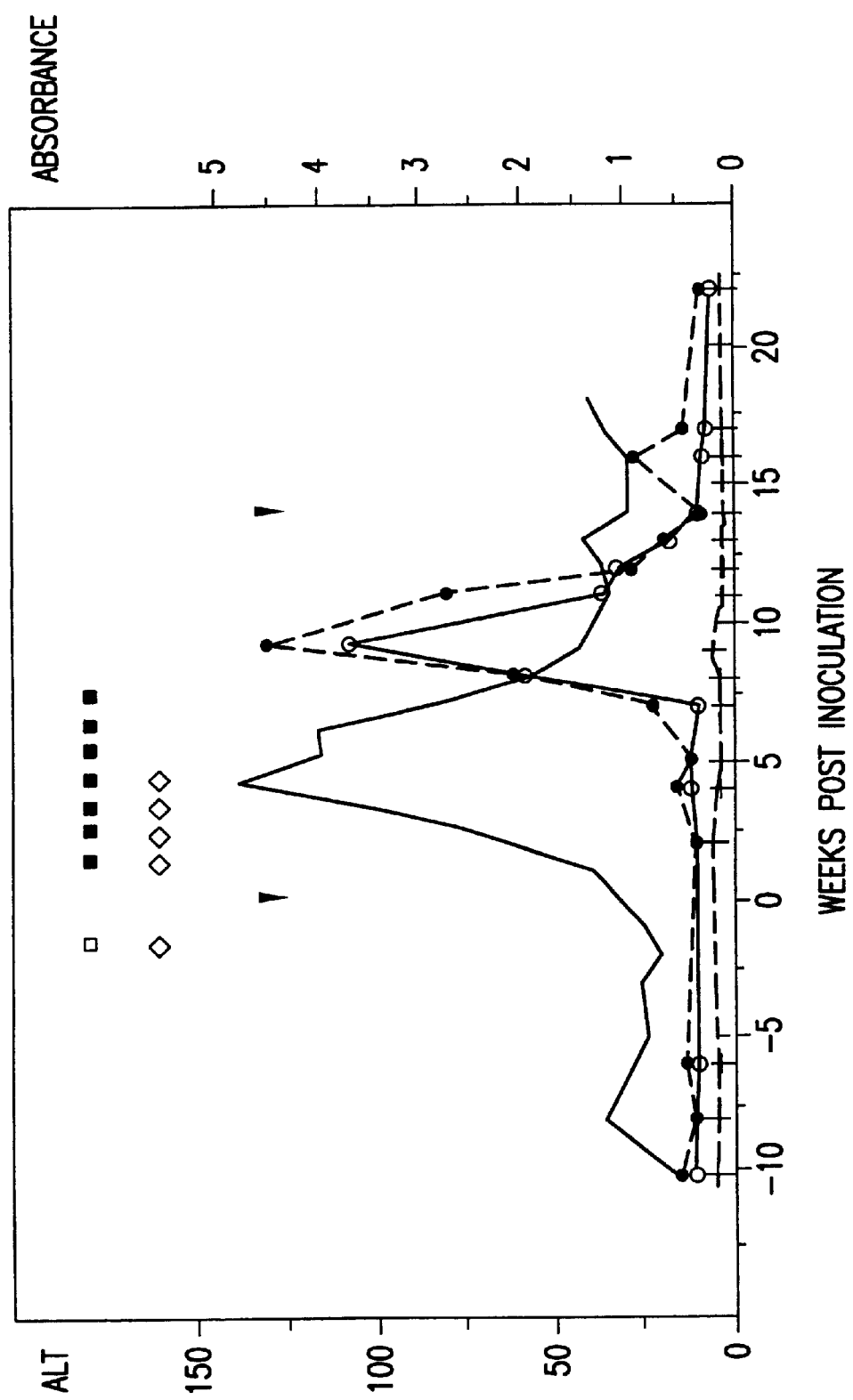
Figure 27:
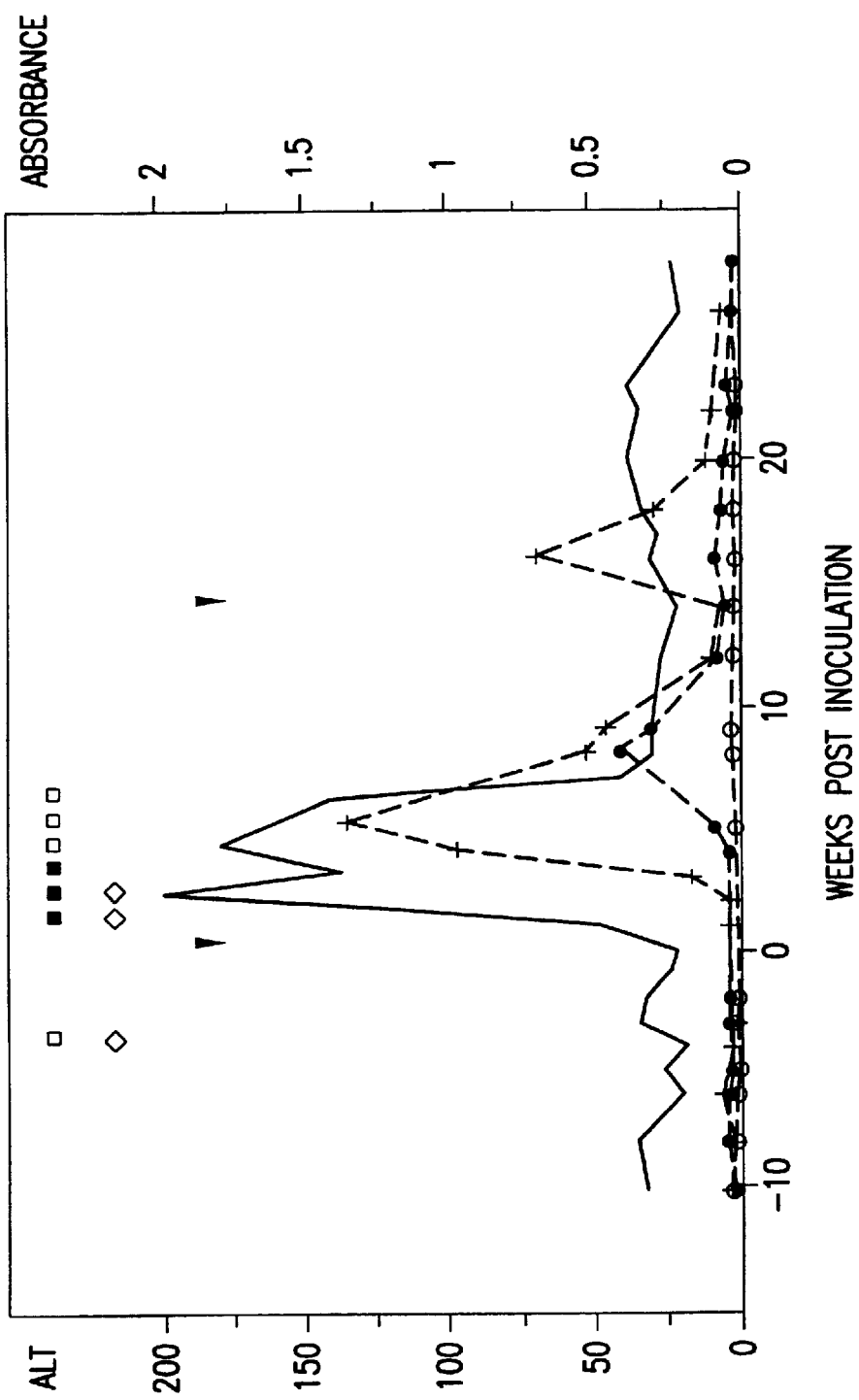

As shown in FIG. 26, specific antibodies were detected in T-1048 sera with the 1.7 and 1.4 ELISA's on days 56–84 but not on days 97 and 137 PI. Specific antibodies were not detected in T-1048 sera tested with the 4.1 ELISA. As shown in FIG. 27, antibodies to the 1.7 protein (SEQUENCE I.D. NO. 604) were detected in T-1057 serum at 56 and 63 days PI, but not after 63 days PI. Antibodies to the 4.1 protein (SEQUENCE I.D. NO.606) were detected on days 28–63 PI but not on days 84–97 PI. As noted above, tamarins were challenged with a second dose of the H205 inoculum on day 97 PI. Specific antibodies to the 4.1 protein (SEQUENCE I.D. NO. 606) were detected on days 112 and 126 PI, suggesting an anamnestic response to the inoculum. No antibody reactivity was noted for the 1.4 recombinant protein (SEQUENCE I.D. NO. 605).

Figure 28:
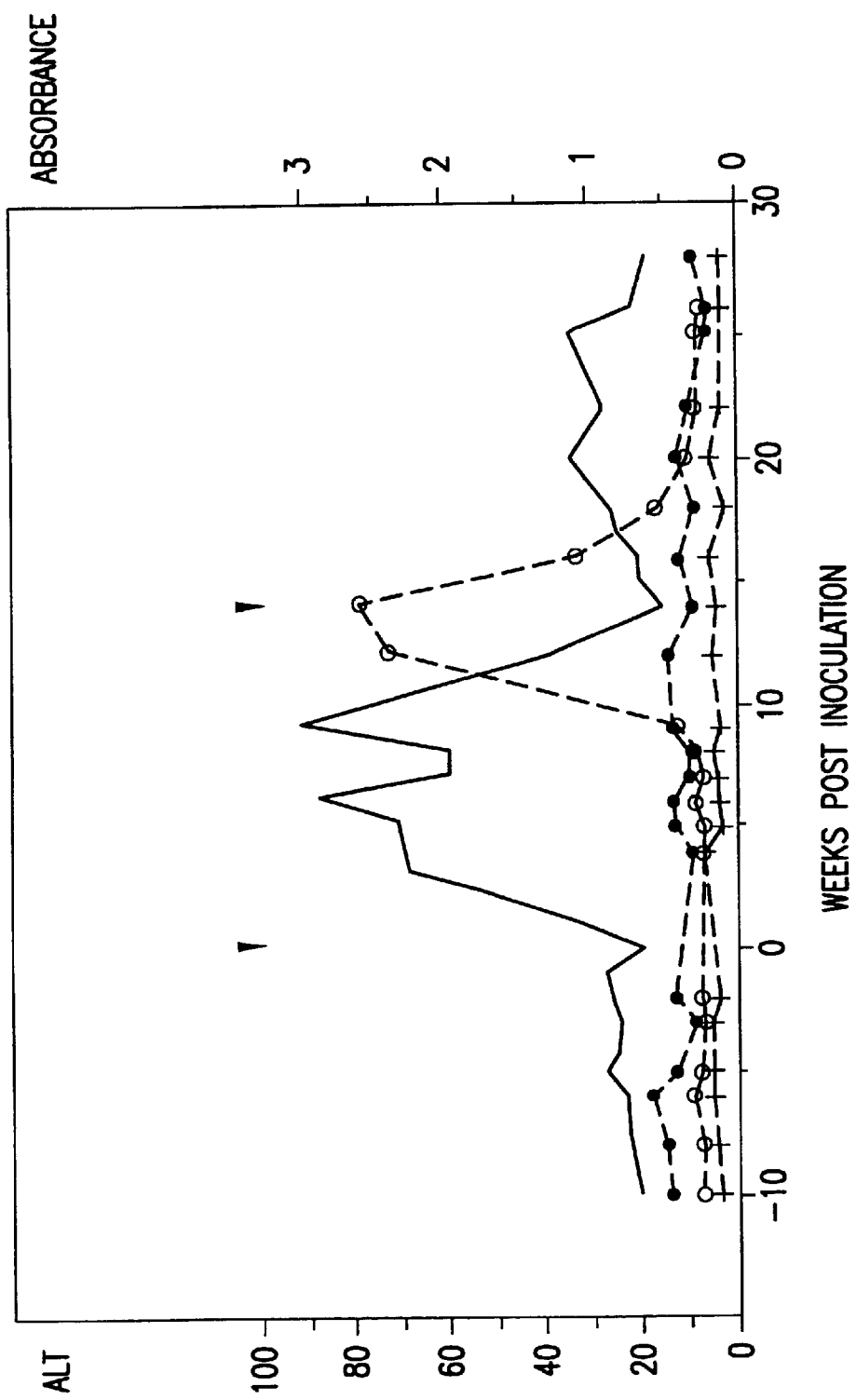

Specific antibodies to the recombinant 1.4 protein (SEQUENCE I.D. NO. 605) were detected in the serum of tamarin T-1061 between 84 and 112 days PI, but were not detected after 126 days PI. As shown in FIG. 28, Tamarin T-1061 sera were negative for antibodies to the 1.7 protein (SEQUENCE I.D. NO. 604) and to the 4.1 protein (SEQUENCE I.D. NO. 606) for 350 days PI.

2. PCR Results on Tamarins (Initial Infectivity Studies)

Selected sera obtained from tamarins T-1048 and T-1057 were tested for HGBV RNA via RT-PCR using primers from clone 4 as described in Example 7) and from clone 16 as described in Example 7.

HGBV RNA was not detected via RT-PCR with either set of primers in the serum obtained 10 and 17 days prior to inoculation (T-1048) as shown in FIG. 26, or 17, 37 and 59 days prior to inoculation (T-1057), as shown in FIG. 27. For T-1048, HGBV RNA was detected via RT-PCR using primers from clone 4 on fifteen of seventeen different sera obtained between 7–137 days PI. HGBV RNA was not detected via RT-PCR using primers from clone 16 in any of the 10 sera obtained on days 7–97 PI. After the challenge with T-1053 plasma, four of five sera obtained between 8 and 40 days after the challenge were positive for clone 16. For T-1057, positive RT-PCR results were obtained on four sera obtained on days 7–28 PI, using primers from clone 4, as shown in FIG. 27. RT-PCR performed on specimens drawn beyond day 28 PI were negative for clone 4, except for day 287 which showed a weak hybridization signal. Neither of the six specimens obtained from T-1057 on day 7–97 PI were positive via RT-PCR using primers from clone 16. However, sera obtained between 8–85 days after the T-1053 challenge were positive using primers from clone 16.

3. ELISA Results on Tamarins (Titration/Transmissibilty Studies)

Figure 29:
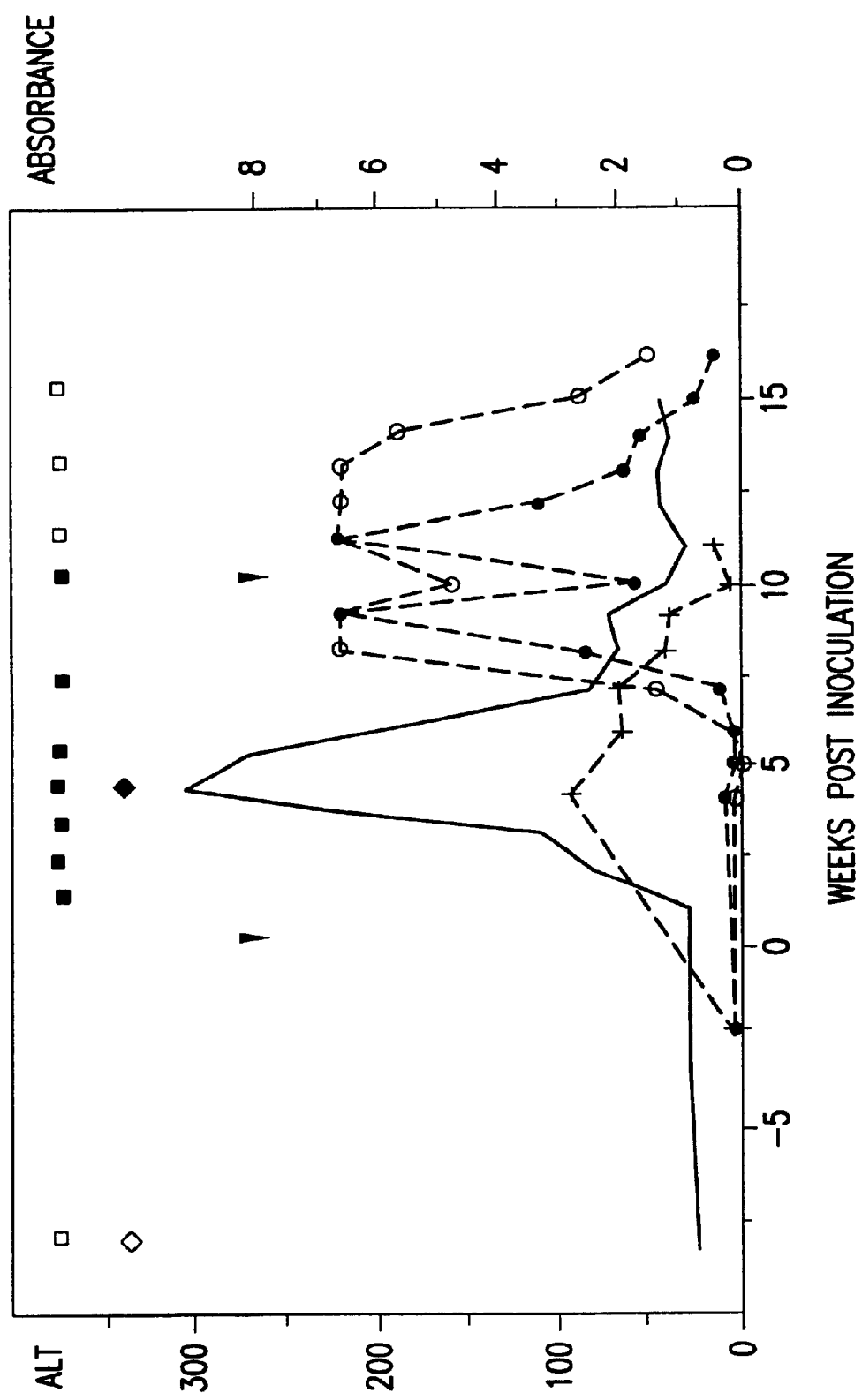

As described in Example 2, serum from tamarin T-1053 was inoculated into four tamarins. Three of these four tamarins were euthanized during the acute stage of the disease (between days 12 and 14 PI). The RT-PCR results obtained on these three tamarins are described below. The surviving tamarin (T-1051) first developed elevated liver enzyme values by day 14 PI and these values persisted for at least 8 weeks PI. Specimens from tamarin T-1051 were tested in the 1.7 and 1.4 ELISA's; the results are shown in FIG. 29. Specific antibodies were not detected in the pre-inoculation serum nor in serum drawn in the first 41 days PI. However, an antibody response was noted against the 1.4 protein (SEQUENCE I.D. NO. 605), and the 1.7 protein (SEQUENCE I.D. NO. 604) between 49 and 113 days PI and the 4.1 protein (SEQUENCE I.D. NO. 606) between 28 and 105 days PI. The tamarin was euthanized during the 113th day PI.

Tamarin (T-1034) was previously inoculated with 0.1 ml of potentially infectious serum obtained from a patient (original GB source) who was recovering from a recent hepatitis infection as described in Example 1 and in TABLE 4. No elevations in liver enzyme values were noted in T-1034 for nearly 10 weeks after inoculation. For this reason, it was decided that tamarin T-1034 could be used in an additional study. Tamarin T-1034 was inoculated with a preparation of HGBV prepared as described in Example 4 ?? from a pool of serum obtained from three tamarins (T-1055, T-1038 and T-1049) previously inoculated with serum from tamarin T-1053.

These three tamarins (T-1055, T-1038 and T-1049) were inoculated with serum prepared from tamarin T-1053 as described in Example 2. Elevated liver enzyme values were noted in all 3 tamarins by day 11 PI. Tamarin T-1055 was sacrificed on day 12 PI: tamarins T-1038 and T-1049 were sacrificed on day 14 PI. Serum from these tamarins was pooled, clarified and filtered. Tamarin T-1034 was inoculated with 0.25 ml of a $10^{-6}$ dilution (prepared in normal tamarin serum) of this filtered material.

Elevated ALT liver enzyme values were first noted in T-1034 at 2 weeks PI, and remained elevated for the next 7 weeks, finally normalizing by week 10 PI. As demonstrated in FIG. 30, a specific antibody response to the 1.4 (SEQUENCE I.D. NO. 22) recombinant protein was first detected on day 49 PI and continued to be detected on days 56–118 PI. The antibody response to the 4.1 (SEQUENCE I.D. NO. 52) recombinant protein was first detected on day 49 PI and continued to be detected between days 56–77 PI, but was not detected on between days 84–118 PI. The antibody response to the 1.7 (SEQUENCE I.D. NO. 604) recombinant protein was first detected on day 56 PI and continued to be detected between days 63–118 PI. The tamarin was sacrificed on day 118 PI.

As described in Example 2, tamarin T-1044 was inoculated with serum obtained from T-1057 that had been obtained 7 days after the H205 inoculation. This inoculum was positive only for sequences detected with clone 4 primers. The inoculum was negative by RT-PCR with clone 16 primers. Mild elevations in ALT levels above the cutoff were observed from days 14–63 PI. As demonstrated previously, a specific antibody response to the 1.7 (SEQUENCE I.D. NO. 604) recombinant protein was detected between 63–84 days PI. No antibody response to the 4.1 (SEQUENCE I.D. NO. 606) recombinant protein or to the 1.4 (SEQUENCE I.D. NO. 605) recombinant protein was detected. The tamarin was sacrificed on 161 days PI.

4. PCR Results on Tamarins (Titration/Transmissibilty Studies)

Sera obtained from T-1049 and T-1055 during the 8th week prior to inoculation and T-1038 on the day of inoculation, were negative by RT-PCR for sequences to clone 16 (SEQUENCE I.D. NO. 26) and clone 4 (SEQUENCE I.D. NO. 21). Tamarins T-1049 and T-1055 were positive for clone 4 sequences (SEQUENCE I.D. NO. 21) by RT-PCR 1 week after inoculation (clone 16 PCR was not done). Prior to the day of sacrifice, T-1049 (14 days PI) as well as T-1055 (11 days PI) were positive by RT-PCR for both clone 4 (SEQUENCE I.D. NO. 21) and clone 16 sequences (SEQUENCE I.D. NO. 26). Tamarin T-1038 was positive with both sets of primers on the day of sacrifice (14 days PI).

Figure 30:
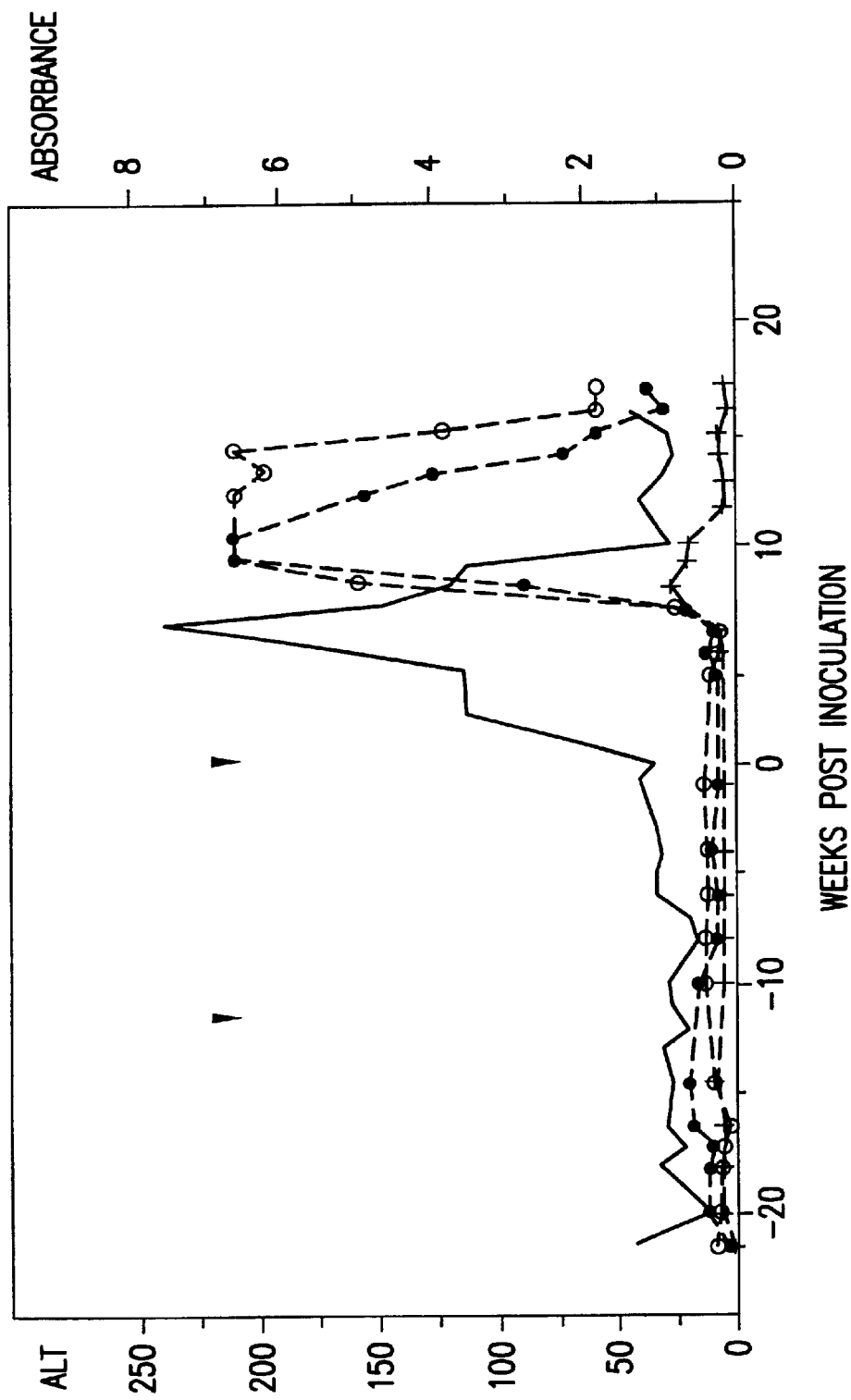

As seen in FIG. 30, T-1034 was positive by RT-PCR for sequences detected with clone 4 primers on the first serum sample obtained after inoculation (7 days PI) and remained positive to day 70 PI. A sample obtained on day 112 PI was negative. All of these samples were negative by RT-PCR with clone 16 primers. Samples obtained 70 and 101 days prior to inoculation were negative with both sets of primers.

As can be seen in FIG. 29 for tamarin T-1051, HGBV RNA was not detected with either set of primers (from clones 4 and 16 as described above) in the serum specimen obtained 8 weeks prior to inoculation. HGBV RNA was detected by RT-PCR using primers from clone 4 on six sera obtained between days 7–69 PI, but not on days 77, 84, 91, or 105 PI. HGBV RNA was detected by RT-PCR using primers from clone 16 on nine samples obtained after inoculation.

Figure 7:
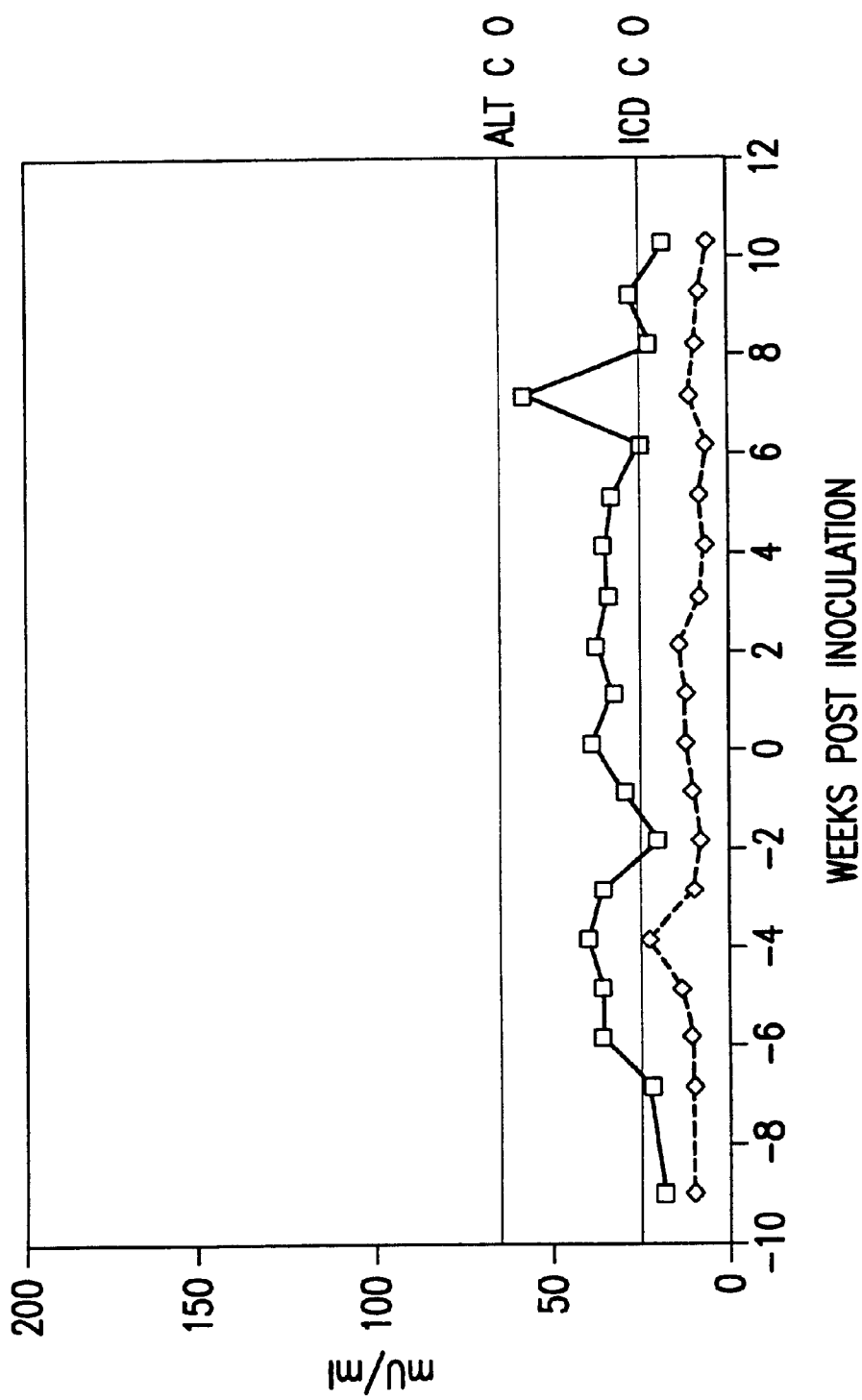
Figure 8:
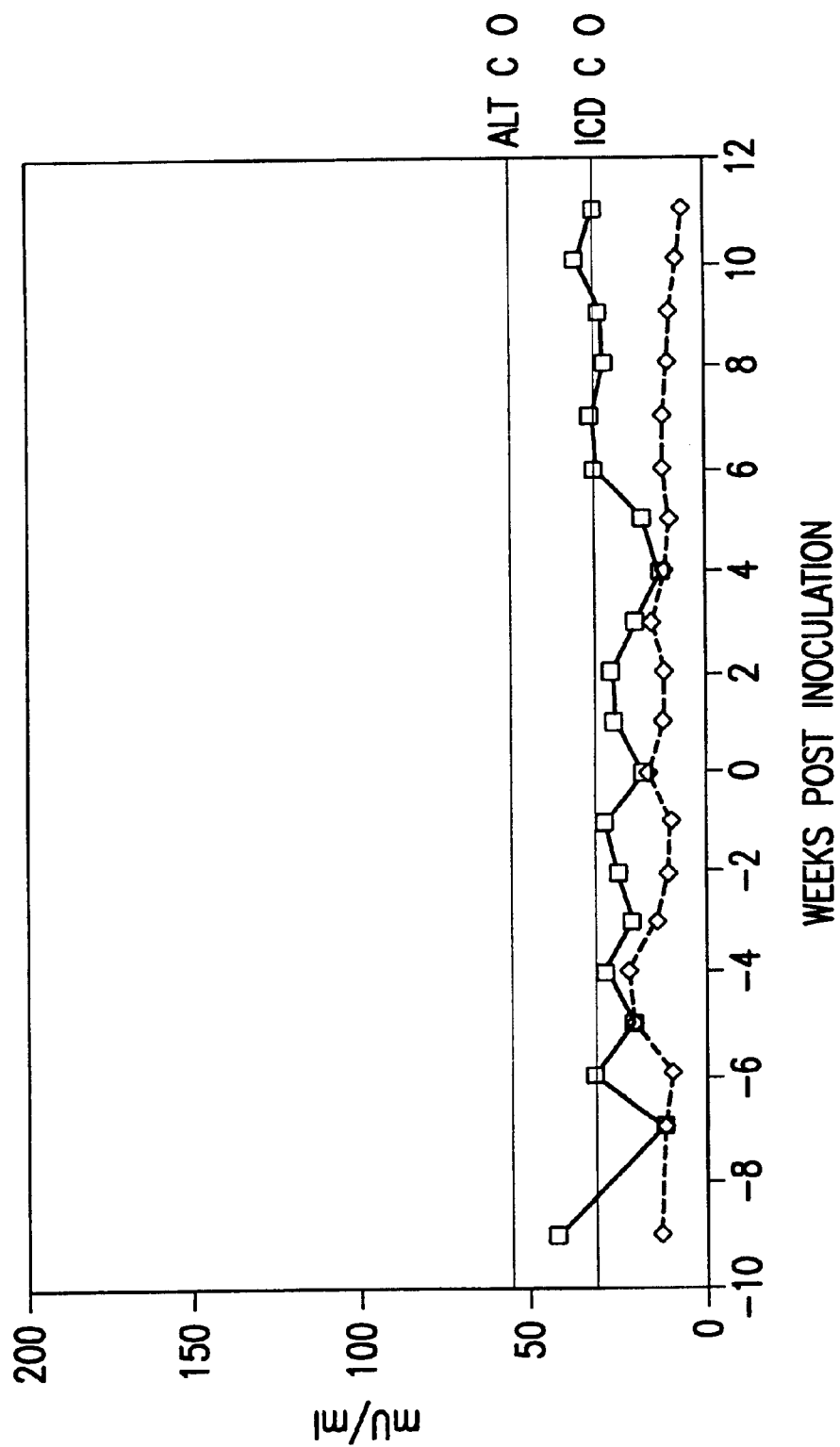

As seen in FIG. 7, T-1044 was positive by RT-PCR for sequences detected with clone 4 primers on the first serum sample obtained after inoculation (7 days PI) and remained positive to day 63 PI. Samples obtained between days 77–119 were negative. All of these samples were negative by RT-PCR with clone 16 primers. A sample obtained 42 days prior to inoculation was negative for both sets of primers.

Tamarins T-1047 and T-1056 were inoculated with T-1044 serum obtained 14 days PI. Nine samples obtained between 7–64 days PI from both of these animals were positive by RT-PCR with clone 4 primers (SEQUENCE I.D. NOS. 8 and 9) but negative with clone 16 primers.

Tamarin T-1058 was inoculated with neat T-1057 serum obtained 22 days after the challenge with T-1053 serum. This inoculum was positive for sequences detected with clone 16 primers but negative with clone 4 primers. Serum samples obtained from this animal were tested with primers derived from GBV-sequences [clone 16, clone 2 clone 10 and clone 18)] and GB-B sequences [clone 4 and clone 50]. A sample obtained 9 days prior to inoculation was negative with all primer sets. A sample obtained 14 days PI was positive only with clone 10 and 18 primers. A sample obtained 21 days PI was positive only with clone 16, 10 and 18 primers. A sample obtained 28 days PI was positive only with clone 18 primers. A sample obtained 35 days PI was positive only with clone 2, 16 (and 18 primers. A sample obtained 41 days PI was positive only with clone 16 and 18 primers. All samples tested were negative with primers from clone 4 and clone 50.

5. Summary of Serological Studies in Tamarins

Five tamarins were inoculated with various preparations of HGBV and developed elevated liver enzyme values by two weeks PI. These elevations persisted for the next six to eight weeks. A specific antibody response to one or more HGBV recombinant antigens, 1.7, 1.4, and 4.1 was noted in all five tamarins. In all cases, the antibodies were first detected by six to ten weeks PI, and persisted for two to seven or more weeks. In general, the antibody levels peaked and then declined rapidly over the next several weeks. It is observed that the antibodies become detectable shortly after the liver enzyme values returned to normal levels, suggesting that the generation of antibodies may play a role in clearing the viral infection.

6. Summary of PCR Studies on Tamarins

The results of the genomic walking experiments suggest that clone 4 (SEQUENCE I.D. NO. 21) and clone 16 (SEQUENCE I.D. NO. 26) reside on separate RNA molecules. We previously provided arguments that supported the idea that there are two distinct viral genomes, one comprised partly of clone 4 (SEQUENCE I.D. NO. 21) and one comprised partly of clone 16 (SEQUENCE I.D. NO. 26). The observation that some animals are positive with primers from clone 4 and not with primers from clone 16 supported the existence of two distinct viral genomes. However, it can also be argued that the inability to detect clone 16 (SEQUENCE I.D. NO. 26) sequence in some of the infected tamarins may reflect a lower limit of sensitivity of the clone 16 primer set relative to the clone 4 primer set. If this latter possibility was the case, then a tamarin positive for both primer sets should exhibit a difference in sensitivity with these two primer sets. In order to support the explanation that these results are explained by the existence of two separate viruses, and not differences in sensitivities of these two primer sets, PCR was performed on a dilution series of cDNA from tamarins T-1057 and T1053. T-1057 serum was positive at $5 \times 10^{-3}$ but negative at $5 \times 10^{-4}$ $\mu$l serum equivalents with clone 4 primers. As much as 20 $\mu$l of T-1057 serum was used for RT-PCR with clone 16 primers with negative results. If this difference was due to the relative sensitivity of the two primer sets (clone 4 vs. clone 16), one would expect that other specimens would also show a 4000 fold higher endpoint dilution when tested by PCR. However, cDNA derived from T-1053 serum was found to be positive at $2.5 \times 10^{-4}$ but negative at $2.5 \times 10^{-5}$ $\mu$l serum equivalents for both clone 4 (SEQUENCE I.D. NO. 21) and clone 16 (SEQUENCE I.D. NO. 26) sequences. These observations are therefore not consistent with a difference in sensitivity of primer sets but are consistent with the existence of contig B-clone 4 (SEQUENCE I.D. NO. 21) and contig A-clone 16 (SEQUENCE I.D. NO. 26) sequences on separate viral genomes of roughly equal titer in T-1053 but differing in titer by at least 4000 fold in T-1057. This data is therefore consistent with the existence of two separate viruses which may have different relative endpoint titers in different specimens.

The observation that HGBV-B viremia alone was sufficient to cause elevations in liver enzyme levels and that no elevations were observed during a GBV-A-only viremic stage, indicated that HGBV-B was the probable causative agent for hepatitis in these tamarins. The immune response to the HGBV-B antigens appeared to be for a short duration, at most 150 days PI. One explanation could be that the selection of epitopes used in these ELISAs was not from the dominant epitopes to which the immune response is generated. Another explanation could be that in tamarins the hepatic challenge may not be significant enough to necessitate a long-lived response. This is consistent with histological evidence from animals that were sacrificed during the acute phase of the disease or had died of natural causes some time after the acute phase which showed that hepatic inflammation ranged from mild to not significant (results not shown).

Five of six animals described in this study resolved viremia of HGBV-B by 112 days PI. In contrast, Tamarin T-1048 remained viremic for 136 days and was found to be viremic at the time of death (137 days PI). Of the four animals that were positive for GBV-A sequence, three showed resolution by 77 days after the first appearance of GBV-A sequence. In contrast, tamarin T-1061 was viremic for 245 days up to the time the animal was sacrificed. In addition, tamarin T-1051 was viremic up to the time of sacrifice (day 113 PI), however, it is unclear if this persistent viremia is due to the initial inoculation with T-1053 plasma or a result of the subsequent challenge with additional T-1053 plasma 69 days later.

The average peak ALT value for the six animals positive for both HGBV-A and HGBV-B was higher than the average value for the four HGBV-B-only animals. In addition, the peak value occurred, on average, earlier in animals positive for GBV-A and GBV-B than for animals positive only for GBV-B. These results suggest that the intensity of the hepatitis may be related to the presence of both agents at significant levels. The observation from the additional passage of GBV-B into tamarins T-1047 and T-1056 that minimal elevation in liver enzymes occurred with GBV-B viremia supports this assumption that both agents may be necessary for major elevations in ALT levels to occur in tamarins. In addition to the passage of HGBV-B alone, initial results from the inoculation of T-1058 with HGBV-A inoculum suggest thatH GBV-A can be transmitted independent of any detectable HGBV-B as indicated by the absence of any detectable GB-B sequences with clone 4 and clone 50 primers.

F. Experimental Protocol for Demonstrating Exposure to HGBV in Human Populations Specimens were obtained from various human populations and tested for antibodies to HGBV utilizing three separate ELISA's utilizing recombinant proteins derived from HGBV-B. The 1.7 ELISA utilized the CKS-1.7 recombinant protein (SEQUENCE I.D. NO. 604) coated onto the solid phase; the 1.4 ELISA utilized the CKS-1.4 recombinant proteins (SEQUENCE I.D. NO. 605) coated on the solid phase and the 4.1 ELISA utilized the 4.1 recombinant protein (SEQUENCE I.D. NO. 606) coated on the solid phase as described in Example 15.B. As also noted in Example 15.E, tamarins inoculated with HGBV produce a specific, but short-lived antibody response to these proteins. In view of the transient nature of this detectable immune response, a negative result in human populations would not necessarily exclude previous exposure to HGBV.

The objective of the serological studies conducted with human specimens was two-fold. First, the seroprevalence of antibodies to the current HGBV recombinant antigens in various human populations was to be determined. These studies included testing (1) populations considered at "low risk" for exposure to HGBV (e.g. healthy volunteer blood donors in U.S.); (2) populations considered to be "at risk" for exposure to HGBV (e.g. specimens obtained from intravenous drug users and hemophiliacs are frequently seropositive for parenterally transmitted hepatitis viruses (HBV and HCV); specimens obtained from individuals residing in developing nations are frequently seropositive for enterically transmitted viruses (HAV and HEV); (3) panels of specimens obtained from individuals with "non-A-E hepatitis" that is not associated with exposure to known hepatitis viruses (HAV, HBV, HCV, HDV or HEV) or to other viruses associated with hepatitis such as cytomegalovirus (CMV) or Epstein-Barr Virus (EBV). In some cases, members of the panels under the general heading of non A-E hepatitis were not tested for antibodies to HEV. Therefore, all specimens in the non A-E group which were reactive with the 1.7, 1.4 or 4.1 ELISA's were retested with an HEV ELISA assay (available from Abbott Laboratories, Abbott Park, Ill.). Positive anti-HEV results were noted with samples from three sites (Pakistan, U.S. and New Zealand), as explained hereinbelow.

One would expect to observe higher seroprevalence rates among populations "at risk" for exposure to HGBV and among individuals with non-A-E hepatitis, than among populations considered to be at "low risk" for exposure to HGBV.

The second objective of the serological studies was to examine specimens found to be positive for antibodies to one or more HGBV epitopes by RT-PCR to determine if the virus is present in serum. It is well known that HBV and HCV can establish a viremic state which persists for months or years, and in general, that HAV and HEV establish a short-lived viremia persisting in general for several weeks. In cases of HBV and HCV infection which are acute, resolving hepatitis, the viremic stage may also be short-lived persisting for several weeks. Thus, RT-PCR can be used to provide evidence that the virus is present in an infected individual. However, because the viremic state can be short-lived, a negative RT-PCR result for a given agent can be observed in individuals who are infected with that agent.

G. Cutoff Determination

Previous experience with other ELISA's utilizing the indirect assay format indicated that a preliminary cutoff value can be calculated based on the absorbance values obtained on a population presumably negative for antibodies to the protein being studied. A preliminary cutoff value was calculated as the sum of the mean absorbance value of the population plus 10 standard deviations from the population mean. Since the cutoff value was to be used every time a panel was run, a more convenient method to express the cutoff was as a factor of the negative control (pool of normal human plasma—NHP) which was run in replicates of five for each assay run. For the 1.7, 1.4 and 4.1 ELISA's, the negative control typically had an absorbance value of between 0.030 and 0.060. As described below, the cutoff values were calculated to be at an absorbance value of approximately 0.300 to 0.600, which was equivalent to an absorbance signal of ten times the negative control value. Thus, in order for a specimen to be considered reactive, the ratio of the sample (S) absorbance value to the negative (N) control absorbance value (S/N ratio) had to be equal to or greater than 10.0.

H. Supplemental Testing

Specimens which were initially reactive were typically retested in duplicate. If one or both of the retest absorbance values were above the cutoff value, the specimen was considered repeatably reactive. Specimens which were repeatably reactive were then tested with supplemental assays which may further support the ELISA data. Repeatably reactive specimens which had sufficient volume may be tested by Western blot to determine that the antibody response was directed against the CKS-1.7 (SEQUENCE I.D. NO. 604), a CKS-1.4 (SEQUENCE I.D. NO. 605) or CKS 4.1 (SEQUENCE I.D. NO. 606) antigens and not to E. coli proteins which may have been co-coated on the solid phase with the major protein of interest. For a Western blot result to be considered positive, a visible band had to be detected at 80 kD for the 1.7 protein (SEQUENCE I.D. NO. 604), 60–70 kD for the 1.4 protein (SEQUENCE I.D. NO. 605) or at 42 kD for the 4.1 protein (SEQUENCE I.D. NO. 606). Since the Western blot has not been optimized to match or exceed the sensitivity of the ELISA's, a negative result was not used to discard the ELISA data. However, a positive result reinforced the reactivity detected by the ELISA's.

Repeatably reactive specimens which had sufficient volume may be tested by RT-PCR (performed as described in Example 15.D using clone 4 primers to identify HGBV specific nucleotide sequences in serum. A positive result would indicate a viremic specimen and would ultimately help in establishing the role of HGBV in human hepatitis. A negative result, however, was not to be construed to indicate that the ELISA results was incorrect. As noted in the tamarin study in Example 15.E, RT-PCR results were positive in the first several weeks after infection and then became negative at about the time when antibodies were just beginning to be detected with the current ELISA's. These later specimens may be RT-PCR negative but positive in one or both of the ELISA's.

1. Serological Data Obtained with Low-Risk Specimens

A population consisting of 100 sera and 100 plasma was obtained from healthy, volunteer blood donors in Southeastern Wisconsin and tested for antibodies to the 1.7 (SEQUENCE I.D. NO. 604) and 1.4 (SEQUENCE I.D. NO. 605) and 4.1 (SEQUENCE I.D. NO. 606) recombinant proteins utilizing the ELISA's described above. The absorbance values obtained with the 1.7, 1.4 and 4.1 ELISA's for serum and plasma were plotted separately (FIGS. 9–14).

For the 1.7 ELISA, the mean absorbance values for the serum and plasma specimens were 0.072 [with a standard deviation (SD) of 0.061] and 0.083 (SD=0.055), respectively. Thus, for the 1.7 ELISA's, the tentative cutoff values for serum and plasma were 0.499 and 0.468, respectively. As discussed above, the cutoff also was expressed as a factor of the negative control absorbance value: specimens having S/N values above 10.0 were considered reactive. Using this cutoff value, 0 of 200 specimens tested for antibodies to 1.7 (SEQUENCE I.D. NO. 604).

For the 1.4 ELISA, several specimens (three from the serum population and six from the plasma population) had absorbance values greater than 0.300 (S/N's of 6–12, near or above the expected cutoff value). When retested, all nine of these specimens produced S/N values of less than 10.0. The mean absorbance value for the serum and plasma specimens were 0.072 (SD=0.052) and 0.108 (SD=0.062), respectively. The cutoff for the 1.4 ELISA was calculated using the formula described above; the cutoff values for serum and plasma populations were 0.436 and 0.542, respectively. One specimen from the serum population was initially reactive and when re-tested in duplicate was negative. Two specimens from the plasma population were initially reactive but were negative upon re-test. A second population of 200 normals was tested including 100 plasma and 100 serum. Using the proposed cutoff, two plasma and two sera were repeatably reactive.

For the 4.1 ELISA, the mean absorbance values for the serum and plasma specimens were 0.070 [with a standard deviation (SD) of 0.037] and 0.063 (SD=0.040), respectively. Thus, for the 4.1 ELISA, the tentative cutoff values for serum and plasma were 0.329 and 0.511, respectively. As discussed above, the cutoff also was expressed as a factor of the negative control absorbance value; specimens having S/N values above 10.0 were considered reactive. Using this cutoff value, 0 of 100 plasma specimens and 0 of 100 serum specimens were initially reactive for antibodies to 4.1 (SEQUENCE I.D. NO.606).

An additional 760 plasma donors from the Interstate Blood Bank (Ohio) were tested with the 1.7 and 1.4 ELISAs. A total of 9 specimens were repeatably reactive. None of the specimens were reactive in both ELISAs. All 9 specimens were repeatably reactive with the 1.4 ELISA.

In total, 960 specimens from plasma or blood donors residing in the U.S. were tested for antibodies to the 1.7 and 1.4 proteins. A total of 13 specimens were repeatably reactive by the 1.4 ELISA. None of the specimens were repeataby reactive with the 1.7 ELISA.

In summary, these data indicate that, with the existing ELISA's, a total of 13 of 960 specimens obtained from U.S. blood donors were reactive for antibodies in one or more of the ELISA's employing recombinant antigens from HGBV-B. These data suggest that HGBV may be endemic in the U.S.

These data are summarized in TABLE 16.

J. Specimens Considered "At Risk" for Hepatitis

The data for these studies is summarized in TABLE 16.

(i) Specimens from West Africa

A total of 181 of 1300 specimens obtained from West Africa were repeatably reactive in one or more of the ELISA's. One specimen was repeatably reactive in all 3 ELISA's. A total of 43 specimens were repeatably reactive with the 1.7 ELISA, 91 specimens were repeatably reactive with the 1.4 ELISA and 51 specimens were repeatably reactive in the 4.1 ELISA.

One of six specimens repeatably reactive in the 1.7 ELISA was reactive by Western blot for the 1.7 protein (SEQUENCE I.D. NO. 604). Nine of 9 specimens (100%) which were repeatably reactive in the 1.4 ELISA were positive by Western blot for antibodies to the 1.4 protein (SEQUENCE I.D. NO. 611). One specimen was positive by Western blot for both proteins. Twelve of 12 specimens (100%) repeatably reactive in the 4.1 ELISA were positive by Western blot for the 4.1 protein (SEQUENCE I.D. NO. 606.

Three repeatably reactive specimens (including one specimen positive in the 1.4 ELISA and one specimen positive in both ELISA's and both Western blots) were tested for HGBV RNA by RT-PCR using primers from clone 4 as described above. All three specimens were negative by RT-PCR.

These data suggest that HGBV may be endemic in West Africa.

(ii) Specimens from Intravenous Drug Users (IVDU's)

Set 1: Three of 112 specimens were positive with the 1.4 ELISA. Five specimens were reactive on 4.1 ELISA and three on 1.7 ELISA. Two samples were positive on more than one ELISA.

Set 2: A total of 99 specimens were obtained from a population of intravenous drug users, as part of a study being conducted at Hines Veteran's Administration Hospital, in Chicago, Ill. None of these specimens were reactive in the 1.7 or 4.1 ELISA. One specimen was repeatably reactive in the 1.4 ELISA. This repeatably reactive specimen was tested for HGBV RNA by RT-PCR using primers from clone 4 as described above. This specimen was RT-PCR negative.

K. Specimens Obtained from Individuals with Non A-E Hepatitis

The data for these studies is summarized in TABLE 16.

Various populations of specimens were obtained from individuals diagnosed as having non-A-E hepatitis and tested with the 1.7, 1.4, and 4.1 ELISA's described in Example 15.C. These specimens included: 180 specimens obtained from a Japanese clinic; 56 specimens from a clinic in New Zealand; 73 specimens obtained from a clinic in Greece; 132 specimens from a clinic in Egypt; 64 specimens from a U.S. clinic in Texas (set T), 72 specimens from a research center in Minesota (set M); 62 specimens from U.S. (set #1); 82 specimens obtained from a clinic in Pakistan; 10 specimens from a clinic in Italy. (Due to insufficient volumes of some sera, certain specimens from these groups were not tested on all of the available ELISAs).

(i) Specimens from Japan

These 180 specimens were obtained from 85 different patients. These two reactive specimens came from 2 individuals. A total of 2 of 180 specimens were repeatably reactive in the 1.7 ELISA. These 2 specimens were tested by RT-PCR using primers from clone 4 as described above. None of the specimens were positive.

None of the specimens were positive in the 1.4 ELISA.

For the 4.1 ELISA, seven of 89 specimens were repeatably reactive in the 4.1 assay. (Note: these 89 specimens were obtained from 29 different patients). Five of the reactive specimens were obtained from one patient. The remaining two were from a different patient.

(ii) Specimens from New Zealand

A total four of 56 specimens were repeatably reactive in one or more of the ELISA's 1.7, 1.4, and 4.1. None of these specimens were reactive in two or more ELISA's. One specimen was repeatably reactive in the 1.7 ELISA and two specimens were repeatably reactive in the 1.4 ELISA. One specimen was repeatably reactive with the 4.1 ELISA. PCR was performed on two repeatably reactive specimens; both specimens were negative. One specimen which was repeatably reactive in the 1.4 ELISA was also reactive for antibodies to HEV.

(iii) Specimens from Greece

A total of 5 of 73 specimens were found to be reactive for antibodies in the 1.7 and/or 1.4 ELISA's. These 73 specimens were obtained from a total of 11 patients. Two of the five repeatably reactive specimens were repeatably reactive for both ELISA's and were obtained from one individual on different dates. Two repeatably reactive specimens were tested by RT-PCR and were negative. None of these specimens were reactive for antibodies with the 4.1 ELISA.

(iv) Specimens from Egypt

Figure 31:
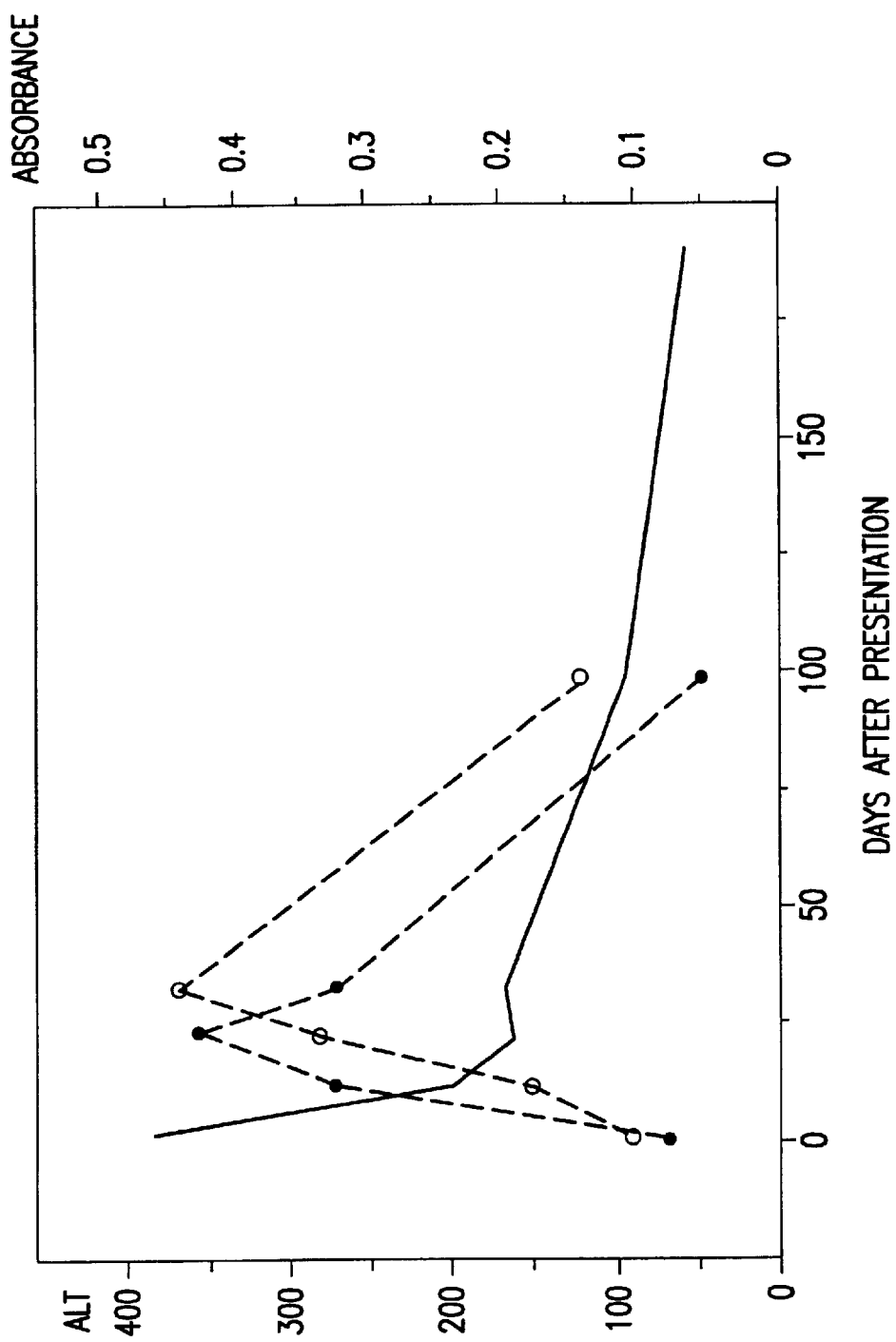
Figure 32:
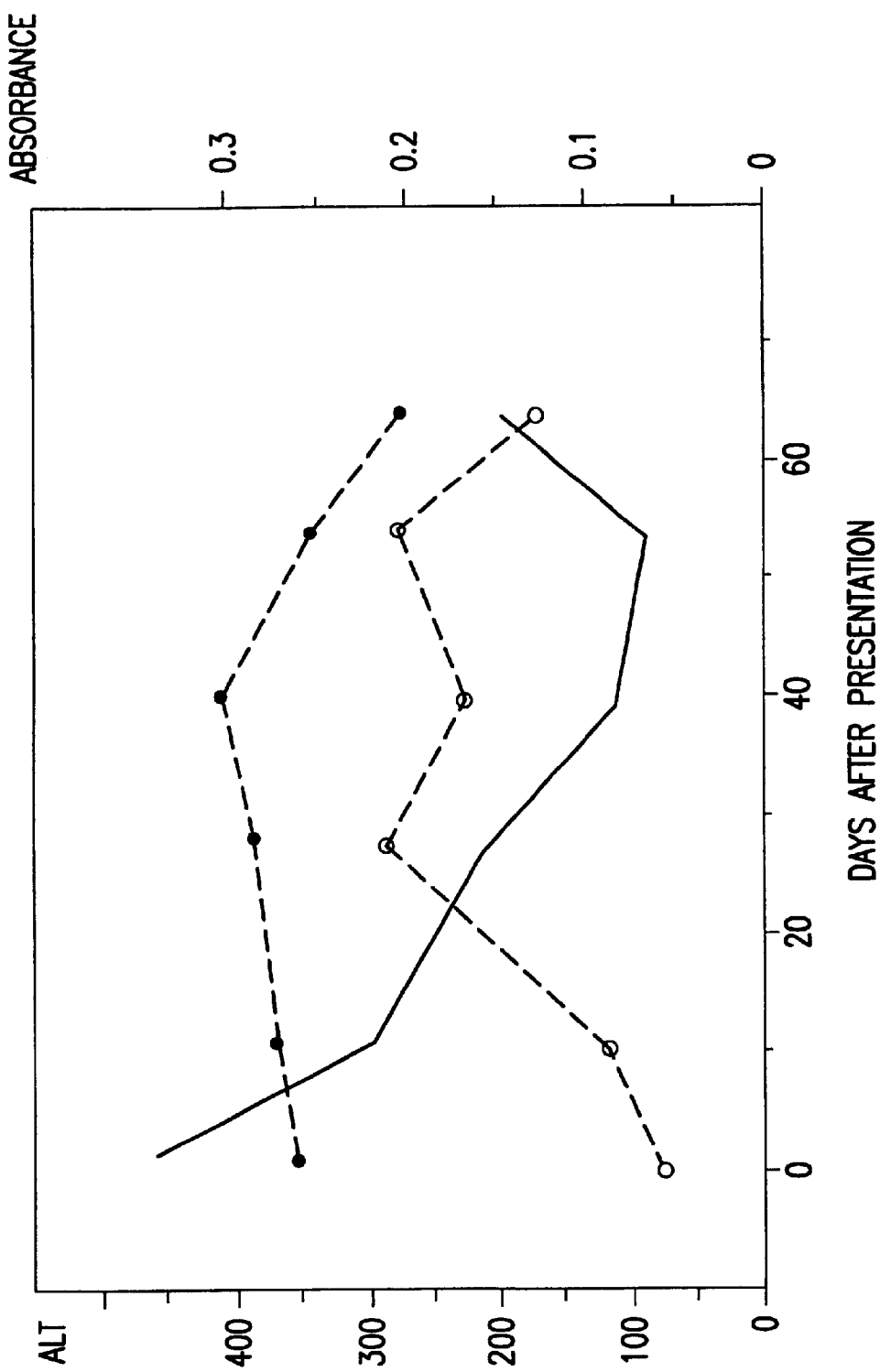
Figure 33:
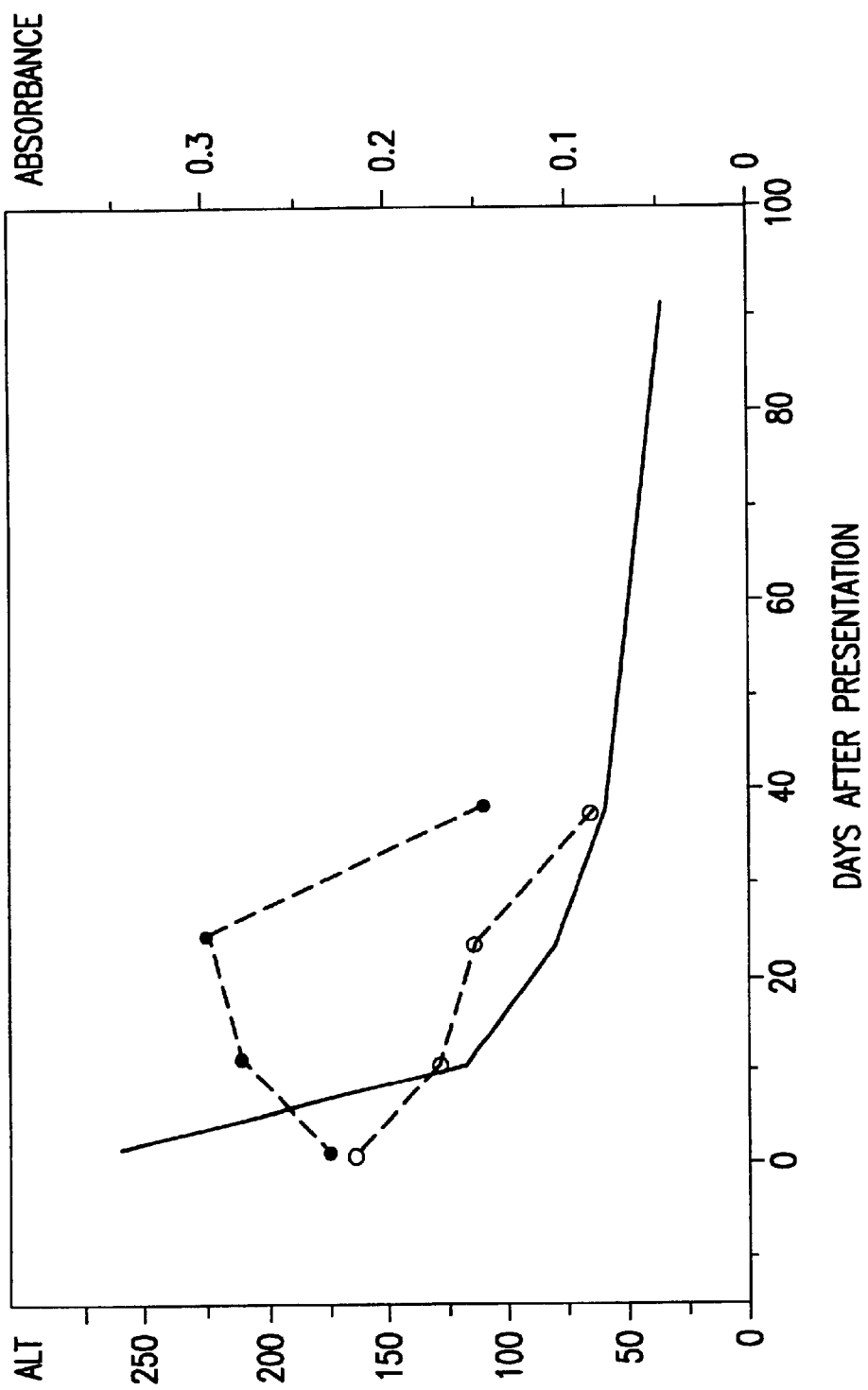
Figure 34:
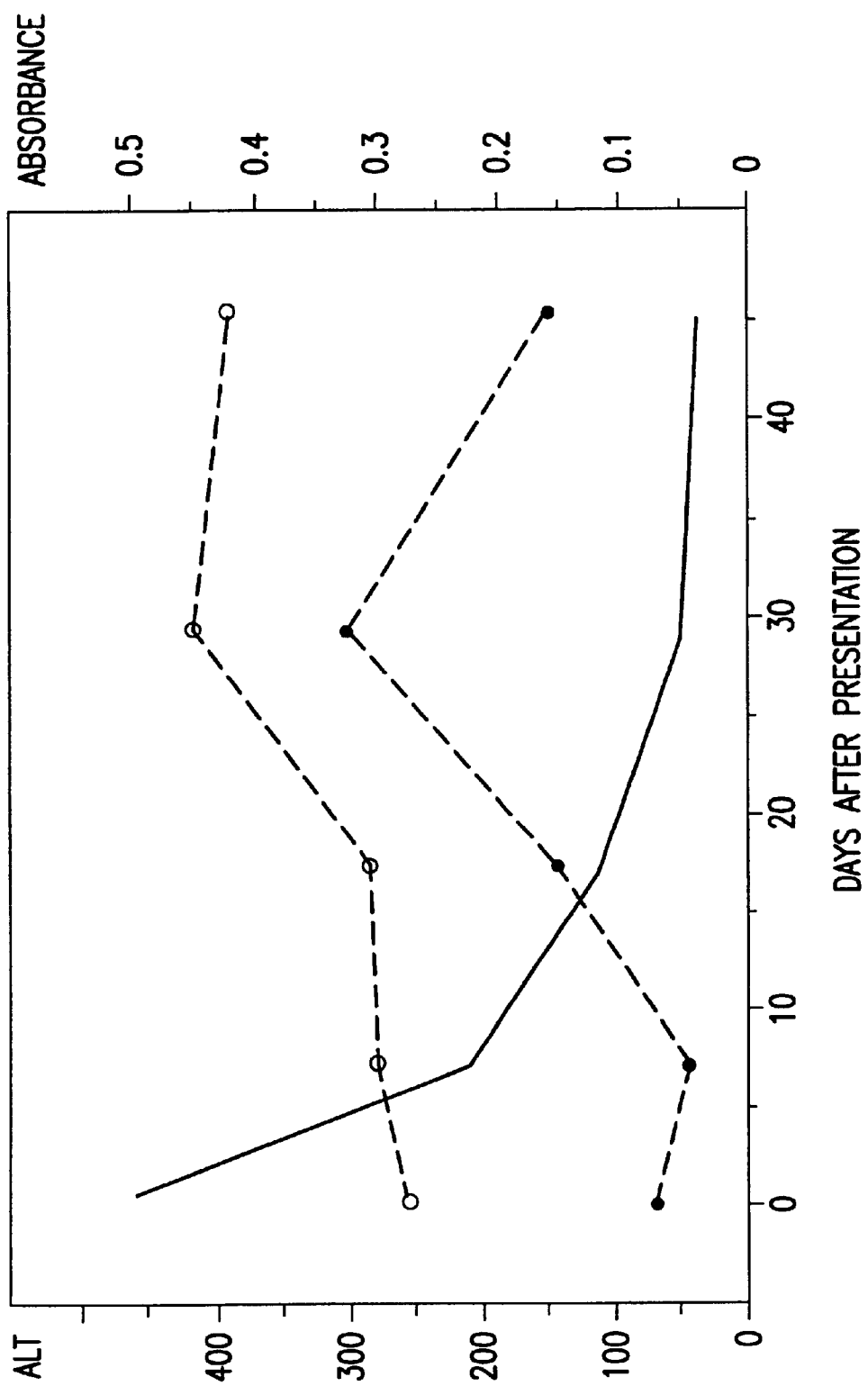

A total of 11 of 132 specimens were reactive in the 1.7, 1.4, or 4.1 ELISA's. Eight specimens were positive in both the 1.7 and 1.4 ELISA's. Nine specimens were reactive for antibodies in the 1.7 ELISA and 9 specimens were reactive in the 1.4 ELISA. One specimen repeatably reactive in the 4.1 ELISA but negative in the 1.7 and 1.4 ELISAs. One specimen repeatably reactive in the 1.7 ELISA was tested by Western blot and was negative for antibodies to the 1.7 recombinant protein (SEQUENCE I.D. NO. 604). Six of nine specimens repeatably reactive in the 1.4 ELISA tested positive by Western blot for antibodies to the 1.4 recombinant protein (SEQUENCE I.D. NO. 605). Seven of the repeatably reactive specimens were tested by RT-PCR; none of the specimens were reactive. These 132 specimens were obtained on different dates from 25 different individuals. The 11 repeatably reactive specimens were obtained from five different individuals. For one of these individuals (patient #101), the immune response clearly mimics that observed with the tamarins (FIG. 31). Note that in FIG. 31, the ALT levels were elevated at the time of presentation of symptoms to the physician. In subsequent specimens, the ALT levels declined and antibodies were detected utilizing the 1.4 and 1.7 ELISA's. The antibody response declined over the next several weeks as was noted with the serologic profiles observed in the tamarins. Three additional patients (257, 260, and 340) exhibited serologic patterns similiar to patient #101 (as shown in FIGS. 32–34. These data provide supportive evidence that HGBV may be the etiologic agent in these cases of hepatitis.

None of the seven specimens obtained from these four patients were positive for HGBV RNA by RT-PCR. There are several potential reasons for these results. First, the viremic phase may have been very short-lived: the virus may have been cleared from the serum by the time of the first bleed date. Secondly, these specimens were shipped from Egypt and may potentially have been frozen and thawed or otherwise compromised during the storage and shipping process, thus reducing the potential to detect HGBV RNA.

(v) Specimens from U.S. (Set T)

None of 64 specimens from the U.S. (set T) were repeatably reactive in the 1.7, 1.4 or 4.1 ELISA.

(vi) Specimens from U.S. (Set M)

A total of 4 of 72 specimens from U.S. specimens (set M) were repeatably reactive in one or more of the ELISA's. Two specimens were reactive with the 1.7 and 4.1 ELISA's. One specimen was reactive only with 1.7 and one specimen was reactive only with the 4.1 ELISA.

vii) Specimens from the United States (set 1)

A total of three of 51 specimens from non A-E hepatitis U.S. set 1 were repeatably reactive in one or both of the ELISA's. One specimen was repeatably reactive in both ELISA's. One specimen was reactive in the 1.7 ELISA and three specimens were repeatably reactive in the 1.4 ELISA. The specimen positive in both ELISA's was positive by Western blot for the 1.4 recombinant protein (SEQUENCE I.D. NO. 22) but negative for the 1.7 recombinant protein (SEQUENCE I.D. NO. 23). One additional specimen was positive in the 1.4 ELISA and Western blot positive for the 1.4 recombinant protein (SEQUENCE I.D. NO. 605). One specimen which was repeatably reactive in the 1.4 ELISA was reactive for antibodies to HEV.

(viii) Specimens from Pakistan

A total of four of 82 specimens were repeatably reactive for antibodies in 1.4 and/or 1.7 ELISAs. None of the specimens were reactive in both ELISA's. Two specimens were repeatably reactive in the 1.7 ELISA and two specimens were repeatably reactive in the 1.4 ELISA. Two specimens repeatably reactive in the 1.4 ELISA were also reactive for antibodies to HEV. None of these 82 specimens were positive with the 4.1 ELISA.

(ix) Specimens from Italy

None of the ten specimens were repeatably reactive in the 1.7, 1.4, or 4.1 ELISA.

L. Statistical Significance of Serological Results

These data indicate that specific antibodies to HGBV proteins (i.e. specimens repeatably reactive for antibodies in 1.7, 1.4, or 4.1 ELISA's can be detected in all three categories of populations studied. Serological results obtained with the various categories of specimens ("low risk", "at risk" and non A-E hepatitis patients) were grouped together and analyzed for statistical significance using the Chi square test. The data indicated that there is a significant difference in comparing the seroprevalence of anti-HGBV in volunteer blood donors with either the individuals considered "at risk" for exposure to HGBV or to individuals diagnosed with hepatitis of an unknown etiology.

Among West Africans, the seroprevalence rate is 13.9% and is significantly higher than the baseline group (TABLE 17) with a p value of 0.000. Similiarly, for the IVDU's, there was a statistically significant difference (p value of 0.000) when the results from IVDU's were compared with volunteer donors. In countries (including Japan, New Zealand, U.S., Egypt, and Pakistan), there were significant differences in antibody prevalence in patients with non A-E hepatitis when compared to the volunteer blood donors from the US.

H. Summary

These data suggest that the ELISA's described herein may be useful in diagnosing cases of hepatitis in humans in various geographical regions including Japan, New Zealand, U.S., Egypt, and Pakistan. It is likely that these data underestimate the seroprevalence of antibodies to HGBV among all categories of specimens tested. It is expected that as additional HGBV epitopes are discovered and evaluated, the utility of tests derived from the HGBV genome(s) will become more important in diagnosing hepatitis among patients whose diagnosis cannot currently be made. NOTE: Although the results of RT-PCR were negative in these initial studies, subsequent data revealed flavi-like vial sequences in serum of seropositive individuals (see Example 17).

As we have discussed supra, more than one strain of the HGBV is present. These are considered to be within the scope of the present invention and are termed "hepatitis GB Virus ("HGBV")".

Example 16

Serological Studies with HGBV-A

A. Recombinant Protein Purification Protocol

Bacterial cells expreessing the CKS fusion proteins were frozen and stored at −70 C. The bacterial cells from each of the GBV-A contstructs were thawed and disrupted as described in Example 15 for GBV-B constructs. Further, the recombinant proteins were purified as described for GBV-B recombinant proteins in example 15.

The fractions which were collected during the purification protocol were electrophoretically separated and stained with Coomassie Brilliant Blue R250 and examined for the presence of a protein having a molecular weight of approximately 60 kD (CKS 1.5/SEQUENCE NO. 608), 65 kD (CKS 2.17/SEQUENCE NO. 607), 55 kD (CKS 1.18/SEQUENCE NO. 387) and 66 kD (CKS 1.22/SEQUENCE NO. 387). Fractions containing the protein of interest were pooled and re-examined by SDS-PAGE.

The immunogenicity and structural integrity of the pooled fractions containing the purified antigen were determined by immunoblot following electrotransfer to nitrocellulose as described in Example 13. In the absence of a qualified positive control, the recombinant proteins were identified by their reactivity with a monoclonal antibody directed against the CKS portion of each fusion protein. When the CKS-1.5 protein (SEQUENCE I.D. NO. 608) was examined by Western blot, using the anti-CKS monoclonal antibody to detect the recombinant antigen, a single band at approximately 60 kD was observed. This corresponds to the expected size of the CKS-1.5 protein (SEQUENCE I.D. NO. 608). Similiarly, bands of the expected sizes were noted for the CKS-2.17 protein SEQUENCE I.D. NO. 607), the the CKS 1.18 protein (SEQUENCE NO. 390) and the CKS-1.22 protein (SEQUENCE I.D. NO. 287) when examined by immunoblot.

B. Polystyrene Bead Coating Procedure

The proteins were dialyzed and evaluated for their antigenicity on polystyrene beads described in Example 15.

C. ELISA Protocol for Detection of Antibodies to HGBV

The ELISA's were performed as described in Example 15.

D. Detection of HGBV RNA in Serum of Infected Individuals

Specimens which were repeatably reactive in the ELISAs were tested for HGBV RNA as described in section D. of Example 15.

E. Tamarin Serological Profiles

None of the sera from the tamarins produced a specific immune response when tested in the ELISA utilizing the CKS 1.5 protein, the CKS 2.17 protein, the CKS 1.18 protein or the CKS 1.22 protein, all derived from the HGBV-A genome. However, HGBV-A RNA was detected in several of the infected tamarins as described in the previous example. (See Example 15 for a summary of the tamarin serological profiles).

F. Experimental Protocol for Serologic Studies on Human Populations

In Example 15, ELISA's employing recombinant antigens from HGBV-B were utilized to evaluate the presence of antibodies to HGBV-B in various human populations. Many of the same specimens were then tested for antibodies to HGBV-A utilizing the 1.5 ELISA employing the CKS-1.5 recombinant protein (SEQUENCE I.D. NO. 614), the 2.17 ELISA employing the CKS-2.17 recombinant protein (SEQUENCE I.D. NO. 607), the 1.18 ELISA employing the CKS-1.18 recombinant protein (SEQUENCE I.D. NO. 287), and the ELISA employing the CKS-1.22 recombinant protein (SEQUENCE I.D. NO. 287), coated on the solid phase (as described in Example 15). As noted in Example 15, all five of the convalescing tamarins inoculated with HGBV produced a specific but short-lived antibody response to the HGVB-B recombinant proteins (as detected with the 1.7, 1.4 and 4.1 ELISA's). Although none of the tamarins produced a detectable antibody response in the 1.5, 2.17, 1.18 or 1.22 ELISAs, some human specimens from West Africa produced a specific antibody response to one or more of these recombinant proteins when tested via Western blot and one of the specimens obtained from the surgeon (who was the source of the GB agent) at 22 days after onset of hepatitis produced a specific antibody response to the 2.17 recombinant protein when tested by Western blot (see Example 3). In the current example, we evaluated the utility of the 1.5, 2.17, 1.18 and 1.22 ELISA's in detecting antibodies in various human populations.

G. Cutoff Determination

The cutoff for the 1.5, 2.17, 1.18, and 1.22 ELISAs were determined as described in Example 15.

H. Supplemental Testing

As noted in Example 15, specimens which were initially reactive were typically retested; if the specimen was repeatably reactive, additional tests (e.g. Western blot) may be performed to further support the ELISA data. For a Western blot result to be considered positive, a visible band should be observed at 60 kD for the 1.5 protein (SEQUENCE I.D. NO. 608) at 65 kD for the 2.17 protein (SEQUENCE I.D. NO. 607), at 55 kD for the 1.18 protein (SEQUENCE I.D. NO. 387) at 66 kD for the 1.22 protein (SEQUENCE I.D. NO. 387). Since the Western blot had not been optimized to match or exceed the sensitivity of the ELISA's, a negative result was not used to discard the ELISA data. However, a positive result reinforced the reactivity detected by the ELISA's.

As also noted in Example 15, repeatably reactive specimens which have sufficient volume may be tested by RT-PCR (performed as described in Example 15) using primers to identify HGBV specific nucleotide sequences in serum.

I. Serological Data Obtained with Low-Risk Specimens

A total of 252 plasma specimens were obtained from the Interstate Blood Bank in Ohio and tested for antibodies with the 1.5 ELISA which utilizes the 1.5 recombinant protein (SEQUENCE I.D. NO. 608). The mean absorbance value for the population was 0.036 (SD=0.022). The cutoff was calculated to be 0.168, corresponding to an S/N value of 10.0. A total of 760 plasma specimens (including the 252 specimens utilized to determine the cutoff) were tested for antibodies with the 1.5 ELISA. None of the specimens were repeatably reactive. In addition, 100 plasma specimens were obtained from Southeastern Wisconsin and tested for antibodies with the 1.5 ELISA. None of the specimens were repeatably reactive.

Thus, there is no evidence that antibodies to the 1.5 protein were present in U.S. blood donors.

A total of 200 specimens were obtained from Wisconsin blood donors and tested for antibodies with the 2.17 ELISA which utilizes the 2.17 recombinant protein (SEQUENCE I.D. NO. 60). The mean absorbance value for the population was 0.058 (SD=0.025). The cutoff was calculated to be 0.208, corresponding to an S/N value of approximately 10.0. One of the specimens was repeatably reactive. Thus, the seroprevalence in U.S. blood donors (N=200) is relatively low.

The same 200 specimens described in the above paragraph were tested for antibodies with the 1.18 and 1.22

ELISAs. None of the specimens were repeatably reactive. Thus, there is no evidence that specimens from volunteer blood donors are antibody positive for HGBV-A proteins as determine by the 1.5, 2.17, 1.18 and 1.22 ELISAs.

J. Specimens Considered "At Risk" for Hepatitis

The data for these studies is summarized in TABLE 18.

(i) Specimens from West Africa

A total of 58 of 1300 specimens were reactive with the 1.5 ELISA. Twelve of 18 repeatably reactive specimens were positive by Western blot for antibodies to the 1.5 protein (SEQUENCE I.D. NO. 608). A total of 43 of 817 specimens were reactive in the 2.17 ELISA. These repeatably reactive specimens were not tested by Western blot for antibodies to the 2.17 protein (SEQUENCE I.D. NO. 607).

Six of the 817 specimens were reactive with the 1.22 ELISA. Nine of the 353 specimens were reactive for 1.18 ELISA. Twenty-one specimens reactive with the 2.17 ELISA were tested by Western blot and 13 were reactive. All eight specimens that were repeatably reactive with the 1.18 ELISA was positive by Western blot.

These data suggest that HGBV may be endemic in West Africa.

(ii) Specimens from Intravenous Drug Users

A total of 112 specimens were obtained from a population of intravenous drug users, as part of a study being conducted at Hines Veteran's Administration Hospital, in Chicago, Ill. One specimen was repeatably reactive in the 2.17 ELISA and an additional specimen was reactive in the 1.18 ELISA. None of these specimens were positive in the 1.5 or 1.22 ELISA.

K. Specimens Obtained from Individuals with Non A-E Hepatitis

The data for these studies is summarized in TABLE 18.

Various populations of specimens (described in Example 15.K) were obtained from individuals with non-A-E hepatitis and tested with the 1.5, 2.17, 1.18 and 1.22 ELISAs (described in Example 15.C). Due to insufficient sample volume, not all specimens were tested in all of the ELISAs.

(i) Specimens from Japan

A total of four of 89 specimens were repeatably reactive in the 1.5 ELISA, with three of the specimens being from one individual and one of the specimens from a second individual. One specimen which had tested negative for the 1.5 ELISA, the 1.18 ELISA and the 1.22 ELISA was reactive in the 2.17 ELISA. None of the specimens were reactive in the 1.18 ELISA. These specimens were not tested with the 1.22 ELISA.

(ii) Specimens from New Zealand

None of these 56 specimens were reactive in the 1.5 ELISA. These specimens were not tested in the 2.17 ELISA, the 1.18 ELISA or the 1.22 ELISA.

(iii) Specimens from Greece

None of the 67 specimens (obtained from a total of 10 patients) were reactive for antibodies with the 1.5, 2.17 or 1.22 ELISA.

(iv) Specimens from Egypt

None of 132 specimens were reactive in the 1.5 ELISA. A total of 7 of 132 specimens available for testing were reactive in the 2.17 ELISA. These specimens were obtained from 25 individuals with acute non A-E hepatitis. Three of the 25 patients were seropositive in the 2.17 ELISA on one or more separate dates following the onset of hepatitis. None were reactive in the 1.18 or 1.22 ELISA.

(v) Specimen from the U.S. (Set M)

None of the 72 specimens were reactive with the 1.5 ELISA. Three of the 72 specimens were reactive for the 1.18 ELISA. Two of the specimens were reactive in the 2.17 ELISA and four specimens were reactive with the 1.22 ELISA. Two of the samples were reactive in one of more of the ELISAs.

(vi) Specimens from U.S. (Set T)

None of the 64 specimens were reactive with the 1.5, 1.22 or 2.17 ELISAs. One specimen was reactive for the 1.18 ELISA.

(vii) Specimens from U.S. (Set 1)

A total of 3 of 62 specimens were reactive in one or more of the GBV-A ELISAs. One specimen was repeatly reactive in both the 2.17 and 1.22 ELISA. One specimen was reactive only in the 2.17 ELISA and an additional specimen was reactive only in the 1.22 ELISA. None of the specimens were reactive in the 1.5 or 1.18 ELISA.

As we have discussed supra, it is possible that more than one strain of the HGBV may be present, or that more than one distinct virus may be represented by the sequences disclosed herein. These are considered to be within the scope of the present invention and are termed "hepatitis GB Virus ("HGBV").

L. Statistical Significance of Serological Results

These data indicated that specific antibodies to HGBV-A proteins (i.e. specimens repeatably reactive for antibodies in 1.5, 2.17, 1,18 and 1.22 ELISA's) were detected among individuals considered "at risk" for exposure to HGBV and among individuals diagnosed with non A-E hepatitis, but were not frequently detected either among volunteer or paid blood donors from the U.S. In TABLE 19, the serological results obtained with the various categories of specimens ("low risk", "at risk" and non A-E hepatitis patients as shown in TABLE 18) were grouped together and analyzed for statistical significance using the Chi square test. Unlike the data in TABLE 18, which compiled the seroprevalence of antibodies to HGBV proteins in the total number of specimens tested, the data in TABLE 19 reflect the results obtained with different individuals (persons). For the GBV-A ELISAs, the data indicate that there is a significant difference (with a p value of 0.000) in comparing the seroprevalence of anti-HGBV in volunteer blood donors with the individuals considered "at risk" for exposure to HGBV (West Africa) but not in the IVDUs. In addition, there was a statistically significant difference between the seroprevalence of antibodies to HGBV-A in individuals with non A-E hepatitis in Egypt and the U.S. when compared to volunteer donors These data suggest that exposure to HGBV-A was associated with non-A through E hepatitis. NOTE: although the results of RT-PCR were negative in these initial studies, subsequent data revealed flavi-like vial sequences in serum of seropositive individuals (see Example 19).

M Summary

These data suggest that the ELISA described herein may be useful in detecting antibodies among individuals residing in West Africa and among individuals with non-A through E hepatitis. The risk for hepatitis among the West Africans is relatively high; nearly 85% of these individuals are seropositive for antibodies to Hepatitis B virus, and approximately 5% are positive for antibodies to hepatitis C virus. It is likely that these data underestimate the seroprevalence of antibodies to HGBV among all categories of specimens tested. It is expected that as additional HGBV epitopes are discovered and evaluated, the utility of tests derived from the HGBV genome(s) will become more important in diagnosing hepatitis among patients whose diagnosis cannot currently be made.

Example 18

Identification of a GB-Related Virus in Humans

A. Theory

Epitopes from both HGBV-A and HGBV-B have been identified (Example 3). These have been used as serologic markers to screen human serum and plasma samples (Examples 5 and 6). A significant correlation between seroreactivity with some of these markers and the incidence of nonA-E hepatitis has suggested that HGBV-B is the causative agent of nonA-E hepatitis in humans (Example 5.G). However, Western blot analysis of GB human sera gave no indication of reactivity to HGBV-B epitopes (Example 3). Instead, at least one HGBV-A epitope was identified with the GB human sera suggesting that HGBV-A was the causitive agent of hepatitis in GB. Neither HGBV-A nor HGBV-B sequences have been identified in patients with nonA-E hepatitis by RT-PCR (Example 5.E). Therefore, proof of HGBV-A and/or HGBV-B infection in humans with nonA-E hepatitis remains to be determined.

The failure to identify HGBV-A and/or HGBV-B sequences in human sera or plasma sources may be due to several factors. First, we have looked at only a limited number of HGBV-A and/or HGBV-B-seropositive samples by RT-PCR, and the complete storage history of many of these samples is unknown. Thus, it is possible that viral RNA present in these samples was compromised by incorrect storage. Second, GB infection appears to be resolving in nature. As such, the window of time in which GB sequences are present in an infected individual's serum may be very narrow. Thus, the chances of obtaining serum samples containing GB sequences may be extremely low. Finally, a limited number of PCR primer sets were used to look for HGBV-A and/or HGBV-B sequences. HGBV-A and/or HGBV-B are RNA viruses and, therefore, are likely to have high rates of mutation (Holland, et al. (1982) *Science* 215:1577–1585). Thus, the sequence of HGBV-A and/or HGBV-B present in the examined human sera may be different enough from the sequence of our PCR primers such that HGBV-A and/or HGBV-B may be not be detected.

To address the possibility that the genomic variability of HGBV-A and/or HGBV-B prevented these viruses in our PCR studies, degenerate PCR primers were designed to the highly conserved NS3-like regions of HGBV-A and HGBV-B (see FIG. 17). It was reasoned that these highly conserved regions serve a necessary function in the viral replicative cycle. Therefore, these sequences should be maintained in HGBV-A and HGBV-B variants. PCR primers designed within this region should be able to detect HGBV-A and/or HGBV-B genomic RNA by RT-PCR. In addition, by designing degenerate PCR primers that can specifically amplify HGBV-A, HGBV-B and HCV sequences, we reasoned that we might be able to amplify sequences from viruses related to HGBV-A, HGBV-B and HCV. Thus, if the limited seroreactivity detected in human serum and plasma samples (Examples 5 and 6) is the result of cross-reactive antibodies to antigens from distinct HGBV-A- or HGBV-B-related viruses, we may be able to obtain sequences from these GB-related viruses. [This is similar to the experimental approach that Nichol and colleagues took to identify the unique Hantavirus associated with the recent outbreak of acute respiratory illness in the Southwest United States. Nichol, et al. *Science* 262:914–917 (1993)].

B. Cloning the NS3-Like Region of Hepatitis GB Virus C (HGBV-C)

In several models of virus infetions, viremia occurs during the early stages of infection and is often associated with the detection of IgM class antibodies to viral proteins. As noted in examples 5 and 6, several specimens were immunoreactive in ELISA's which detected IgG class antibodies to recombinant proteins derived from HGBV-A and HGBV-B. Additional ELISA's were performed to determine if IgM class antibodies could be detected to these proteins. Several seropositive specimens obtained from West African individuals (Example 5.E.i) were reactive for IgM class antibodies to the recombinant proteins (data not shown). These specimens were thought to have a high probability of containing virus. In addition, specimens obtained from HGBV-A- and HGBV-B-seropositive Egyptian individuals (Example 5.F.vii) suffering from acute hepatitis in the absence of detectable IgM class antibodies to HGBV-A or HGBV-B recombinant proteins were also examined due to the likelihood that acute liver disease is most likely linked to viral presence. A "hemi-nested" RT-PCR was performed on the nucleic acids from these samples with degenerate oligonucleotide primers which will amplify HGBV-A, HGBV-B and HCV-1 sequences using the GeneAmp® RNA PCR kit (Perkin Elmer) as directed by the manufacturer. Briefly, the first set of amplifications were performed on the cDNA products of random-primed reverse transcription reactions of the extracted nucleic acids with 2 mM $MgCl_2$ and 1 µM primers ns3.1-s and ns3.1-a (SEQUENCE ID. NOS. 665 and 666, respectively). Reactions were subjected to 40 cycles of denaturation-annealing-extension [three cycles of (94° C., 30 sec; 37° C., 30 sec; 2 min ramp to 72° C.; 72° C., 30 sec) followed by 37 cycles of (94° C., 30 sec; 55° C., 30 sec; 72° C., 30 sec)] followed by a 10 min extension at 72° C. Completed reactions were held at 4° C. The second set of amplifications were as described above except that 4% of the first PCR products were used as the template, and ns3.1-s and ns3-a (SEQUENCE ID. NOS. 665 and 667, respectively) were used as the "hemi-nested" primer set. Products from the first and second sets of PCRs were analyzed by gel electrophoresis.

One sample from West Africa had a PCR product from the hemi-nested reaction that migrated at approximately 386 bp (the expected size of a HGBV-A, HGBV-B or HCV product). This product was cloned into pT7 Blue T-vector plasmid (Novagen) as described in the art. The sequence obtained from this clone (GB contig C [GB-C], SEQUENCE ID. NO. 667, residues 2274–2640) was compared with GB contig A (GB-A, SEQUENCE ID. NO. 163, residues 4438–4804), GB contig B (GB-B, SEQUENCE ID. NO. 390, residues 4218–4587) and HCV-1 (SEQUENCE ID. NO. 395). FIG. 36 shows a nucleotide alignment of these sequences, while TABLE 20 shows the percent identity between these sequences.

TABLE 20

|  | GB-A | GB-B | GB-C | HCV-1 |
|---|---|---|---|---|
| GB-A | 100.0 | 47.99 | 61.66 | 52.55 |
| GB-B |  | 100.0 | 52.55 | 54.96 |
| GB-C |  |  | 100.0 | 57.37 |
| HCV-1 |  |  |  | 100.0 |

As demonstrated in FIG. 36 and TABLE 20, nucleotide comparisons of GB-A, GB-B and HCV-1 show that these sequences are 47.99 to 61.66% identical to one another. This is not surprising when one considers the conserved amino acid residues present in the NTP-binding helicase of these viruses (Example 2.B.3, FIG. 17A). The nucleotide comparison of the NS3 PCR product obtained from the West African sample (GB-C, SEQUENCE ID. NO. 667, residues 2274–2640) with the other viruses suggests that the West African NS3 product (GB-C, SEQUENCE ID. NO. 667, residues 2274–2640) is related to, but distinct from the NS3 sequences from GB-A (SEQUENCE ID. NO. 163, residues 4438–4804), GB-B (SEQUENCE. ID. NO. 390, residues 4218–4587) and HCV-1 (SEQUENCE ID. NO. 395). This sequence comparison suggests that GB-C may be from a GB-like virus more closely related to GB-A than GB-B or HCV. BLASTN and BLASTX searches of nucleic acid and protein databases in the Wisconsin Sequence Analysis Package (Version 8) with GB-C (SEQUENCE ID. NO. 667, residues 2274–2640) finds limited sequence identity with several strains of HCV. The highest P values (i.e. odds of alignment being made by chance) for nucleotide and amino acid searches were $1.9 \times 10^{-20}$ and $5.3 \times 10^{-31}$, respectively (data not shown). Together, these data suggest that GB-C (SEQUENCE ID. NO. 667, residues 2274–2640) may be from a unique GB-like virus related to HGBV-A, HGBV-B and HCV which we now designate, HGBV-C.

C. GB-C is Exogenous

Figure 37:
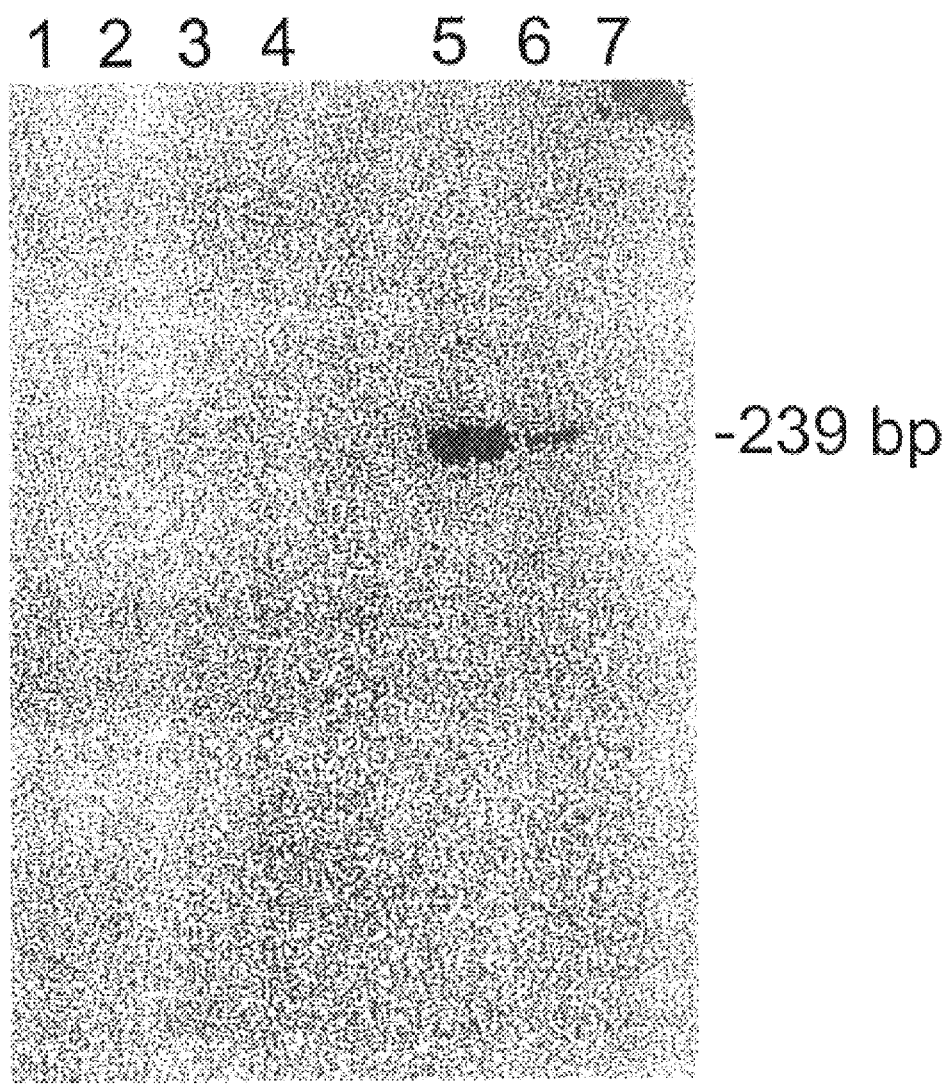
FIG. 37 shows a PhosphoImage (Molecular Dynamics, Sunnyvale, Calif.) from a Southern blot of the PCR products after hybridization with the radiolabeled probe from GB-C

PCR primers to GB-C sequence were utilized to determine whether this sequence could be detected in the genomes of humans, Rhesus monkeys, *S. cerevisiae* and *E.coli* as described, for example, in Example 6.B. PCR was performed using GeneAmp® reagents from Perkin-Elmer-Cetus essentially as directed by the supplier's instructions. Briefly, 300 ng of genomic DNA was used for each 100 µl reaction. PCR primers (SEQUENCE I.D. NOS. 669 and 670) were used at a final concentration of 1.0 µM. PCR was performed for 40 cycles (94° C., 30 sec; 55° C., 30 sec; 72° C., 30 sec) followed by an extension at 72° C. for 10 min. PCR products were separated by agarose gel electrophoresis and visualized by UV irradiation after direct staining of the nucleic acid with ethidium bromide, followed by hybridization to a radiolabeled probe after Southern transfer to a Hybond-N+ nylon filter. FIG. 37 shows a PhospholImage (Molecular Dynamics, Sunnyvale, Calif.) from a Southern blot of the PCR products after hybridization with the radiolabeled probe from GB-C (SEQUENCE I.D. NO. 662, residues 2274–2640). GB-C (SEQUENCE I.D. NO. 667) sequences were not detected in human (FIG. 19, lane 1), Rhesus monkey (lane 2), *S. cerevisiae* (lane 3) or *E. coli* (lane 4) genomic DNAs despite the detection of ~350 fg (one genome copy equivalent, lane 5) and ~35 fg (0.1 genome copy equivalents, lane 6) of GB-C plasmid template in 300 ng human genomic DNA. (Lane 7 contains the PCR products from ~3.5 fg [0.01 genome copy equivalents] GB-C plasmid template in 300 ng human genomic DNA.) Thus, using genomic PCR that can detect 0.1 genome copy equivalents, GB-C (SEQUENCE I.D. NO. 667) cannot be detected in the genomes of human, Rhesus monkey, *S. cerevisiae,* and *E. coli*. These data are consistent with the purported exogenous (i.e. viral) origin of GB-C (SEQUENCE I.D. NO. 667).

D. GB-C can be Detected in Additional Human Serum Samples

Additional HGBV-A and HGBV-B immunoreactive human serum samples were tested for the presence of GB-C sequences using RT-PCR. As in Example 7, nucleic acids extracted from serum samples were reverse transcribed using random hexamers, and cDNAs were subjected to 35–40 cycles of amplification (94° C., 30 sec; 55° C., 30 sec; 72° C., 30–90 sec) followed by an extension at 72° C. for 10 min. GB-C-specific PCR primers (g131-s1 and g131-a1, SEQUENCE ID. NOS. 666 AND 670) were used at 1.0 µM concentration. The PCR products were separated by agarose gel electrophoresis and visualized by UV irradiation after direct staining of the nucleic acid with ethidium bromide and hybridization to a radiolabeled probe after Southern transfer to a Hybond-N+ nylon filter. A total of 48 HGBV-immunopositive samples were tested from West Africa. Including the original sample from which GB-C was identified, eight samples from West Africa were positive for GB-C sequences by RT-PCR. A total of ten GB seronegative West African serum samples were tested, none of which had detectable GB-C sequences. PCR products from four of the positive samples were cloned and sequenced as described above. Over the 156 nucleotides examined, two of four clones examined were identical to GB-C sequence (SEQUENCE I.D. NO. 667, residues 2274–2640), and two clones (SEQUENCE I.D. NOS. 671 and 672) contained sequences that were 88.4% and 83.6% identical to GB-C (SEQUENCE I.D. NO. 667, residues 2274–2640) (FIG. 38). However, despite the divergence at the nucleotide level, the predicted translation product of each clone is remarkably similar with only one amino acid change occurring in the predicted translation of SEQUENCE ID NO. 672.

Additional serum samples from individuals with nonA-E hepatitis from Greece, Egypt and the United States were tested for GB-C sequences as described above. None of these samples contained detectable GB-C sequences. The lack of detection of GB-C sequences in these samples may be due to several reasons (see above, Theory). However, the sequence variation noted above between GB-C (SEQUENCE I.D. NO. 667, residues 2274–2640) and the two GB-C variants (SEQUENCE I.D. NOS. 672 and 671) suggest that if the closely related HGBV-C's from West Africa can differ by 15.1% at the nucleotide level, it is likely that the GB-C-specific PCR primers (g131-s1, g131-a1, SEQUENCE ID. NOS. 669 and 670) may not hybridize sufficiently to geographically distinct isolates of GB-C virus to generate a detectable PCR product. In this case, PCR primers designed to a more conserved region (5' UTR) of the genome may allow the detection of GB-C sequences in non-West African serum samples.

E. Extension of the HGBV-C Sequences

The PCR walking technique described in Example 2.A hereinabove was utilized to obtain additional GB-C sequences. Briefly, total nucleic acid were extracted from the West African human serum originally used to identify GB-C (SEQUENCE I.D. NO. 667, residues 2274–2640). This nucleic acid was reverse transcribed as described supra. The resultant cDNAs were amplified in 50 µl PCR reactions (PCR 1) as described by Sorensen et al. except that 2 min MgCl$_2$ was used. Reactions were subjected to 35 cycles of denaturation-annealing-extension (94° C., 30 sec; 55° C., 30 sec; 72° C., 90 sec) followed by a 10 min extension at 72° C. Biotinylated products were isolated using streptavidin-coated paramagnetic beads (Promega) as described by Sorensen et al. Nested PCRs (PCR 2) were performed on the streptavidin-purified products as described by Sorensen et al. for a total of 35 cycles of denaturation-annealing-extension as described above. The resultant products and the PCR primers used to generate them are listed in TABLE 21.

TABLE 21

| Reaction | Primer set PCR 1 | Primer set PCR 2 | Size of PCR product |
|---|---|---|---|
| C.1 | SEQ ID #673/SEQ ID #135 | SEQ ID #674/SEQ ID #126 | 1250 bp |
| C.2 | SEQ ID #675/SEQ ID #688 | SEQ ID #680/SEQ ID #126 | 220 bp |
| C.3 | SEQ ID #676/SEQ ID #688 | SEQ ID #677/SEQ ID #126 | 250 bp |
| C.4 | SEQ ID #678/SEQ ID #689 | SEQ ID #679/SEQ ID #126 | 800 bp |
| C.5 | comp. of SEQ ID #673/ SEQ ID #689 | SEQ ID #90/SEQ ID #126 | 750 bp |
| C.6 | SEQ ID #682/SEQ ID #666 | SEQ ID #92/SEQ ID #126 | 1150 bp |
| C.7 | SEQ ID #684/SEQ ID #689 | SEQ ID #94/SEQ ID #126 | 550 bp |
| C.8 | SEQ ID #686/SEQ ID #689 | SEQ ID #96/SEQ ID #126 | 250 bp |
| C.9 | 647/SEQ ID #135 | 648/SEQ ID #126 | 625 bp |
| C.10 | 649/SEQ ID #688 | 650/SEQ ID #126 | 350 bp |
| C.11 | 651/SEQ ID #688 | 652/SEQ ID #126 | 550 bp |
| C.12 | 653/SEQ ID #689 | 654/SEQ ID #126 | 450 bp |
| C.13 | 655/659 | 656/SEQ ID #126 | 750 bp |
| C.14 | 657/FP3 (SEQ ID #13) | 658/SEQ ID #126 | 550 bp |
| C.15 | 660/125 | 661/SEQ ID #126 | 600 bp |

In addition, a 1.3 kb product (C.16) was generated with oligonucleotide primers SEQ ID #663 and SEQ ID #664 using PCR 1 conditions described above. This product, together with those described in TABLE 21 were isolated from agarose gels and cloned into pT7 Blue T-vector plasmid (Novagen) as described in the art.

The cloned products were sequenced as described in Example 5. The sequences were assembled using the GCG Package (version 7) of programs. A schematic of the assembled contig is presented in FIG. 39. GB-C is 9034 bp in length, all of which has been sequenced and is presented in SEQUENCE I.D. NO. 397–600. These SEQUENCE I.D.'s corresond to the three forward translation frames.

Example 19

CKS-Based Expression and Detection of Immunogenic HGBV-C Polypeptides

Figure 39:
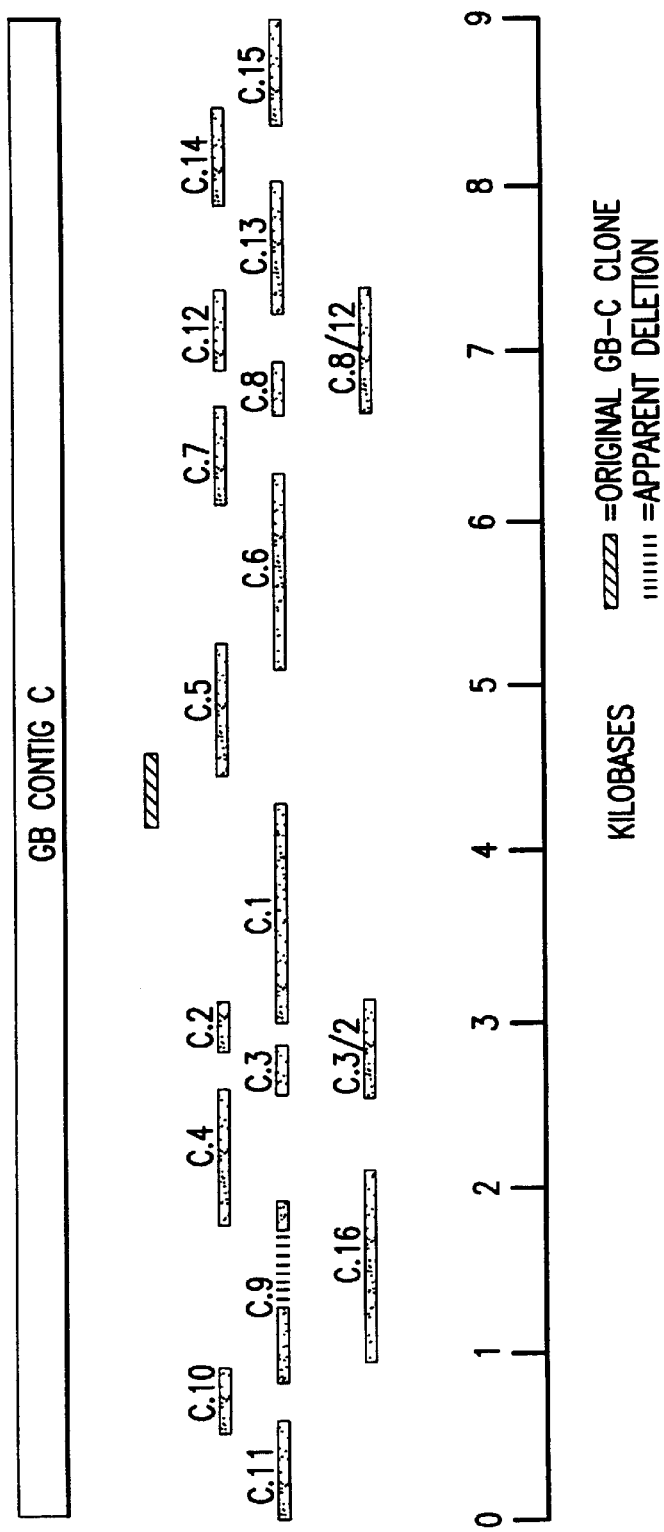
FIG. 39 presents a schematic of the assembled contig of HGBV-C.

The HGBV-C sequences obtained from the walking experiments described in Example 17 (TABLE 13) were cloned into the CKS expression vectors pJO200, pJO201, and pJO202 using the restriction enzymes listed in TABLE 22 (10 units, NEB) as described in Example 13. Two additional PCR clones, designated C.3/2 and C.8/12, were also expressed (FIG. 39). PCR product C.3/2 was generated using primers SEQUENCE I.D. NO. 676 and the complement of SEQUENCE I.D No. 679 and PCR product C.8/12 was generated using primers (SEQUENCE I.D. NO. 687 and its complement) as described in Example 9. The PCR products were cloned into pT7Blue as described previously, then liberated with the restriction enzymes listed in TABLE 22 and cloned into pJO200, pJO201 and pJO202 as above.

Two human sera which had indicated the presence of antibodies to one or more of the CKS/HGBV-A or CKS/HGBV-B fusion proteins by the 1.7, 4.1 or 2.17 ELISAS (see Examples 15 and 16) were chosen for Western blot analysis. One of these sera (240D) was from an individual with nonA-E hepatitis (Egypt) and the other (G8-81) was from a West African individual "at risk" for exposure to HGBV (see Example 15). The CKS/HGBV-C fusion proteins were expressed and transferred to nitrocellulose sheets as described above. The blots were preblocked as described and incubated overnight with one of the human serum sample diluted 1:100 in blocking buffer containing 10% E. coli lysate and 6 mg/ml XL1-Blue/CKS lysate. The blots were washed two times in TBS, reacted with HRPO-conjugated goat anti-human IgG and developed as indicated above. The results are shown in TABLE 22.

Several of the HGBV-C proteins showed reactivity with one or the other of the two sera, and three (C.1, C.6 and C.7) were chosen for use in ELISA assays (see Example 20). Thus, samples previously identified as reactive with HGBV-A and/or HGBV-B proteins additionally show reactivity with HGBV-C proteins. The reactivity with multiple proteins from the 3 HGBV viruses may be due to cross-reactivity resulting from shared epitopes between the viruses. Alternatively, this may be a result of infection with multiple viruses, or to other unidentified factors.

TABLE 22

HGBV-C Samples

| PCR product[a] | Restriction digest[b] | Reactivity with human G8-81 serum | Reactivity with human 240D serum |
|---|---|---|---|
| GB-C | KpnI, XbaI | + | − |
| C.1 | EcoRI, XbaI | + | − |
| C.3/2 | EcoRI, XbaI | − | − |
| C.4 | KpnI, XbaI | − | − |
| C.9 | KpnI, PstI | ND | − |
| C.10 | EcoRI, XbaI | ND | − |
| C.5 | KpnI, XbaI | +/− | − |
| C.6 | KpnI, PstI | + | − |
| C.7 | NdeI-fill, BamHI | − | + |
| C.8/12 | KpnI, XbaI | + | − |

[a]PCR product is as indicated in previous TABLES or Examples.
[b]Restriction digests used to liberate the PCR fragment from pT7Blue T-vector.
ND = not done.

Example 20

Serological Studies with GBV-C
A. Recombinant Protein Purification Protocol

Bacterial cells expressing the CKS fusion proteins were frozen and stored at −70 C. The bacterial cells from each of the GBV-C constructs were thawed and disrupted as described in Example 15 for GBV-B constructs. Further, the recombinant proteins were purified as described for GBV-B recombinant proteins in example 15.

The fractions which were collected during the purification protocol were electrophoretically separated and stained with Coomassie Brilliant Blue R250 and examined for the presence of a protein having a molecular weight of approximately 75 kD (CKS C.1/SEQUENCE I.D. NO. 401), 71 kD (CKS C.6/SEQUENCE I.D. NO. 401), and 49 kD (CKS C.7/SEQUENCE I.D. NO.401). Proteins bands of the expected molecular weight were observed for the CKS-C.6 and CKS-C.7 recombinant proteins. For the CKS-C.1 protein, a band was observed which corresponded to a molecular weight of 62 kD rather than at the expected molecular weight of 75 kD. It is unclear why there are differences between the expected and observed protein band. Fractions containing the protein of interest were pooled and re-examined by SDS-PAGE.

The immunogenicity and structural integrity of the pooled fractions containing the purified antigen were determined by immunoblot following electrotransfer to nitrocellulose as described in Example 13. In the absence of a qualified positive control, the recombinant proteins were identified by their reactivity with a monoclonal antibody directed against the CKS portion of each fusion protein. When the CKS-C.1 protein (SEQUENCE I.D. NO. 401) was examined by Western blot, using the anti-CKS monoclonal antibody to detect the recombinant antigen, a single band at approximately 65 kD was observed. This differs from the expected size of 75 kD for the CKS-C.1 protein (SEQUENCE I.D. NO. 401). Bands of the expected sizes were noted for the CKS-C.6 protein (SEQUENCE I.D. NO. 401), and the CKS C.7 protein (SEQUENCE I.D. NO. 401) were observed when examined by immunoblot.

B. Polystyrene Bead Coating Procedure

The proteins were dialyzed and evaluaed for their antigenicity on polystyrene beads described in Example 15.

C. ELISA Protocol for Detection of Antibodies to HGBV

The ELISA's were performed as described in the previous Example 15.

D. Detection of HGBV RNA in Serum of Infected Individuals

Specimens which were repeatably reactive in the ELISAs were tested for HGBV RNA as described in section D. of the previous example 15.

E. Tamarin Serological Profiles

None of the sera from the tamarins produced a specific immune response when tested in the ELISA utilizing the CKS-C.1 protein, the CKS-C.6 protein, or the CKS C.7 protein, all derived from the HGBV-C genome. See Example 15 for a description of the tamarin serological profiles.

F. Supplemental Testing

As noted in Example 15, specimens which were initially reactive were typically retested; if the specimen was repeatably reactive, additional tests (e.g. Western blot) may be performed to further support the ELISA data. For a Western blot result to be considered positive, a visible band should be observed at 65 kD for the C.1 protein (SEQUENCE I.D. NO. 401), at 71 kD for the C.6 protein (SEQUENCE I.D. NO. 401), or at 49 kD for the C.7 protein (SEQUENCE I.D. NO. 401). Since the Western blot had not been optimized to match or exceed the sensitivity of the ELISA's, a negative result was not used to discard the ELISA data. However, a positive result reinforced the reactivity detected by the ELISA's.

As also noted in Example 15, repeatably reactive specimens which have sufficient volume may be tested by RT-PCR (performed as described in Example 10 using primers corresponding to SEQUENCE I.D. NOS. 8 and 9) to identify HGBV-C specific nucleotide sequences in serum.

G. Experimental Protocol

In example 15, ELISA's employing recombinant antigens from HGBV-B were utilized to evaluate the presence of antibodies to HGBV-B AND HGBV-A in various human populations. Many of the same specimens were then tested for antibodies to HGBV-C utilizing the C.1 ELISA employing the CKS-C.1 recombinant protein (SEQUENCE I.D. NO. 401), the C.6 ELISA employing the CKS-C.6 recombinant protein (SEQUENCE I.D. NO. 401), the C.7 ELISA employing the CKS-C.7 recombinant protein (SEQUENCE I.D. NO. 401) coated on the solid phase (as described in Example 14). As noted in Example 15, all five of the convalescing tamarins inoculated with HGBV produced a specific but short-lived antibody response to the HGVB-B recombinant proteins (as detected with the 1.7, 1.4 and 4.1 ELISA's). Although none of the tamarins produced a detectable antibody response in the C.1, C.6, C.7 ELISAS, some of the human specimens produced a specific antibody response to the C.1, C.6, and C.7 recombinant protein when tested via Western blot (see Example 13) In the current example, we evaluated the utility of the C.1, C.6, and C.7 ELISA's in detecting antibodies in various human populations.

H. Cutoff Determination

The cutoff for the C.1, C.6, and C.7 ELISAs were determined as described in Example 15.

I. Serological Data Obtained with Low-Risk Specimens

A population consisting of 100 sera and 100 plasma was obtained from healthy, volunteer donors in Southeastern Wisconsin and tested for antibodies to three recombinant proteins from GBV-C including the CKS-C.1 (SEQUENCE I.D. NO. 401) protein in the C.1 ELISA, the CKS-C.6 (SEQUENCE I.D. NO. 401) protein in the C.6 ELISA, and the CKS-C.7 (SEQUENCE I.D. NO. 401) protein in the C.7 ELISA.

For the C.1 ELISA, the mean absorbance values for the serum and plasma specimens were 0.049{with a standard deviation (SD) of 0.040} and 0.038 (SD=0.029), respectively. The cutoff for serum and plasma were calculated to be 0.214 and 0.286, respectively. As discussed above, the cutoff value was also expressed as a factor of the negative control absorbance value; specimens having S/N values above 10.0 were considered reactive. Using this cutoff, 0 of 100 plasma specimens and 1 of 100 serum specimens were initially reactive and repeatably reactive for antibodies to the C.1 protein (SEQUENCE I.D. NO. 401).

For the C.6 ELISA, the mean absorbance values for the serum and plasma specimens were 0.102{ with a standard deviation (SD) of 0.046} and 0.105 (SD=0.047), respectively. Cutoff values were set such that specimens having an S/N value of 10 or greater were considered reactive. Using this cutoff, three specimens (two from the serum population and one from the plasma population) were repeatably reactive (having S/N values of 10 or greater) for antibodies to the C.6 protein (SEQUENCE I.D. NO. 401).

For the C.7 ELISA, the mean absorbance values for the serum and plasma specimens were 0.061 {with a standard deviation (SD) of 0.040} and 0.050 (SD=0.055), respectively. Cutoff values were set such that specimens having an S/N value of 10 or greater were considered reactive. Using this cutoff, none of the specimens were repeatably reactive for antibodies to the C.7 protein (SEQUENCE I.D. NO. 401).

Thus, there is evidence that antibodies to the C.1, C.6, or C.7 proteins are present in approximately 1% of U.S. blood donors (N=200).

J. Specimens Considered "At Risk" for Hepatitis

The data for these studies is summarized in TABLE 23.

(i) Specimens from West Africa

A total of 20 of 137 specimens were reactive in one or more of the ELISAs utilizing GBV-C proteins. A total of 12 of 97 were repeatably reactive in the C.1 ELISA, 3 of 52 were repeatably reactive in the C.6 ELISA, 5 of 137 specimens were reactive in the C.7 ELISA. Three of the C.1 reactive specimens were tested on Western blot and found to be reactive.

These data suggest that HGBV may be endemic in West Africa.

(ii) Specimens from Intravenous Drug Users

A total of 112 specimens were obtained from a population of intravenous drug users, as part of a study being conducted at Hines Veteran's Administration Hospital, in Chicago, Ill. A total of 2 of 112 specimens were repeatably reactive for one or more proteins. One specimen was repeatably reactive in the C.1 ELISA, one specimen was repeatably reactive in the C.7 ELISA. None of these specimens were positive in the C.6 ELISA.

K. Specimens Obtained from Individuals with Non A-E Hepatitis

The data for these studies is summarized in TABLE 23.

Various populations of specimens (described in Example 15.K) were obtained from individuals with non-A-E hepatitis and tested with the 1.5, 2.17, 1.18 and 1.22 ELISAs (described in Example 15.C). Due to insufficient sample volume, not all specimens were tested in all of the ELISAs.

(i) Specimens from Japan

None of a total of 89 specimens were repeatably reactive in the C.1 ELISA. Due to lack of specimen volume, the specimens were not tested for antibodies in the C.6 or C.7 ELISAs.

(ii) Specimens from Greece

A total of 67 specimens were tested with the C.1 and C.7 ELISAs. None of the specimens were reactive.

(iii) Specimens from Egypt

A total of 18 specimens of 132 specimens were reactive in one or more ELISA. None of the specimens were reactive in the C.1 ELISA. A total of 15 specimens were reactive in the C.6 ELISA and three were reactive in the C.7 ELISA.

(iv) Specimens from U.S. (M set)

A total of 6 specimens were reactive in one or more ELISA. Two specimens were repeatably reactive in the C.1 ELISA. Four specimens were repeatably reactive in the C.6 ELISA. None of the specimens were reactive in the C.7 ELISA.

(v) Specimens from U.S. (T set)

None of the 64 specimens were reactive in either the C.1 or the C.6 ELISAs. One specimen was repeatably reactive in the C.7 ELISA.

(vi) Specimens from various U.S. clinical sites (set 1)

In total, three of 62 specimens were reactive in one or more ELISA's. One specimen was repeatably reactive in both the C.1 and C.6 ELISA;s. Two specimens were repeatably reactive in the C.7 ELISA.

As we have discussed supra, it is possible that more than one strain of the HGBV may be present, or that more than one distinct virus may be represented by the sequences disclosed herein. These are considered to be within the scope of the present invention and are termed "hepatitis GB Virus ("HGBV").

L. Statistical Significance of Serological Results

These data indicated that specific antibodies to HGBV-C proteins (i.e. specimens repeatably reactive for antibodies in C.1, C.6 and C.7 ELISA's) were detected among individuals considered "at risk" for exposure to HGBV and among individuals diagnosed with non A-E hepatitis, and at low rate among volunteer or paid blood donors from the U.S. In TABLE 24, the serological results obtained with the various categories of specimens ("low risk", "at risk" and non A-E hepatitis patients as shown in TABLE 23) were grouped together and analyzed for statistical significance using the Chi square test. Unlike the data in TABLE 23 which compiled the seroprevalence of antibodies to HGBV proteins in the total number of specimens tested, the data in TABLE 24 reflect the results obtained with different individuals (persons). For the GBV-C ELISAs, the data indicate that there is a significant difference (with a p value of 0.000) in comparing the seroprevalence of anti-HGBV in volunteer blood donors with the individuals considered "at risk" for exposure to HGBV (West Africa) but not for the IVDUs. In addition, there was a statistically significant difference between the seroprevalence of antibodies to HGBV-C in individuals with non A-E hepatitis in Egypt and the U.S. when compared to volunteer donors These data suggest that exposure to HGBV-C was associated with non-A through E hepatitis. NOTE: although the results of RT-PCR were negative in these initial studies, subsequent data revealed flavi-like vial sequences in serum of seropositive individuals (see Example 19).

Example 21

Presence of HGBV-C in Humans with Non-A-E Hepatitis

The generation of HGBV-C-specific ELISAs allowed the identification of immunopositive sera from patients with non-A-E hepatitis (Example for HGBV-C serology). These sera, together with several HGBV-A and/or HGBV-B-immunopositive sera from individuals with documented cases of non-A-E hepatitis (TABLE 25) were examined by RT-PCR for HGBV-C sequences. To increase the likelihood of detecting HGBV-C variants, RT-PCR was performed using degenerate NS3 oligonucleotide primers in a first round of amplification followed by a second round of amplification with nested GB-C-specific primers. Briefly, the first round amplification was performed on serum cDNA products generated as described in Example 6, using 2 mM $MgCl_2$ and 1 $\mu$M primers ns3.2-s1 and ns3.2-a1 (SEQ. ID. NOS. 711 and 712, respectively). Reactions were subjected to 40 cycles of denaturation-annealing-extension [three cycles of (94° C., 30 sec; 37° C., 30 sec; 2 min ramp to 72° C.; 72° C., 30 sec) followed by 37 cycles of (94° C., 30 sec; 50° C., 30 sec; 72° C., 30 sec)] followed by a 10 min extension at 72° C. Completed reactions were held at 4° C. A second round of amplification was performed utilizing 2 mM $MgCl_2$, 1 gM GB-C-specific primers (SEQUENCE I.D. NOS. 669 and 670), and 4% of the first PCR products as template. The second round of amplification employed a thermocycling protocol designed to amplify specific products with oligonucleotide primers that may contain base pair mismatches with the template to be amplified [Roux, *Bio/Techniques* 16:812–814 (1994)]. Specifically, reactions were thermocycled 43 times (94° C., 20 sec; 55° C. decreasing 0.3° C./cycle, 30 sec; 72° C., 1 min) followed by 10 cycles (94° C., 20 sec; 55° C., 40° C., 30 sec; 72° C., 1 min) with a final extension at 72° C. for 10 minutes. PCR products were separated by agarose gel electrophoresis, visualized by UV irradiation after direct staining of the nucleic acid with ethidium bromide, then hybridized to a radiolabeled probe for GB-C after Southern transfer to Hybond-N+ nylon filter. PCR products were cloned and sequenced as described in the art.

Using the above methodology, GB-C.4, GB-C.5, GB-C.6 and GB-C.7 were obtained. These sequences are 82.1–86.6% identical to GB-C (SEQUENCE I.D. NO. 397, bases 4167–4365). FIG. 40 displays the sequence differences of GB-C.4, GB-C.5, GB-C.6 and GB-C.7 aligned to the homologous region of GB-C in the predicted codon triplicates. As demonstrated, a majority of the nucleotide differences do not result in amino acid changes from GB-C. This overall sequence conservation at the amino acid level suggests that GB-C.4, GBC.5, GB-C.6 and GB-C.7 were derived from different strains of the same virus, HGBV-C. In addition, the level of sequence divergence at the nucleotide level demonstrates that these PCR products are not a result of contamination with any of the previously identified GB-C sequences.

Three of these individuals (the sources of GB-C.4, GB-C.5 and GB-C.7) had no evidence of infection with hepatitis A, hepatitis B or hepatitis C viruses. The presence of GB-C sequences in these individuals with hepatitis of unknown etiology suggests that HGBV-C is one of the causative agents of human hepatitis. Serial samples were available for two of the individuals (containing GB-C.4 and GB-C.5). To follow the HGBV-C sequence in these samples, clone specific RT-PCRs were developed. Briefly, nucleic acids extracted from serum were reverse transcribed using random hexamers as in Example 7. The resultant cDNAs were subjected to 40 cycles of amplification (94° C., 30 sec; 55° C., 30 sec; 72° C., 30 sec) followed by an extension at 72° C. for 10 min. GB-C.4-or GB-C.5-specific PCR primers (GB-C.4-s1 and GB-C.4-a1, or GB-C.5-s1 and GB-C.5-a1, respectively) were used at 1.0 $\mu$M concentration. PCR products were separated by agarose gel electrophoresis, visualized by UV irradiation after direct staining of the nucleic acid with ethidium bromide, then hybridized to a radiolabeled probe after Southern transfer to Hybond-N+ nylon filter.

GB-C.4 was found in sera from an Egyptian patient with acute non-A-E hepatitis. This patient was seropositive for a HGBV-A protein (see HGBV-A ELISA Example). RT-PCR of five serial samples from the Egyptian patient demonstrated a viremia that persisted for at least 20 days after normalization of the serum ALT values (TABLE 26). The presence of GB-C sequence after serum ALT normalization suggested that HGBV-C may establish chronic infections in some individuals. However, the absence of additional samples from this patient prevents a conclusion as to the chronic nature of HGBV-C. Additional samples are being pursued to resolve this question.

Figure 41:
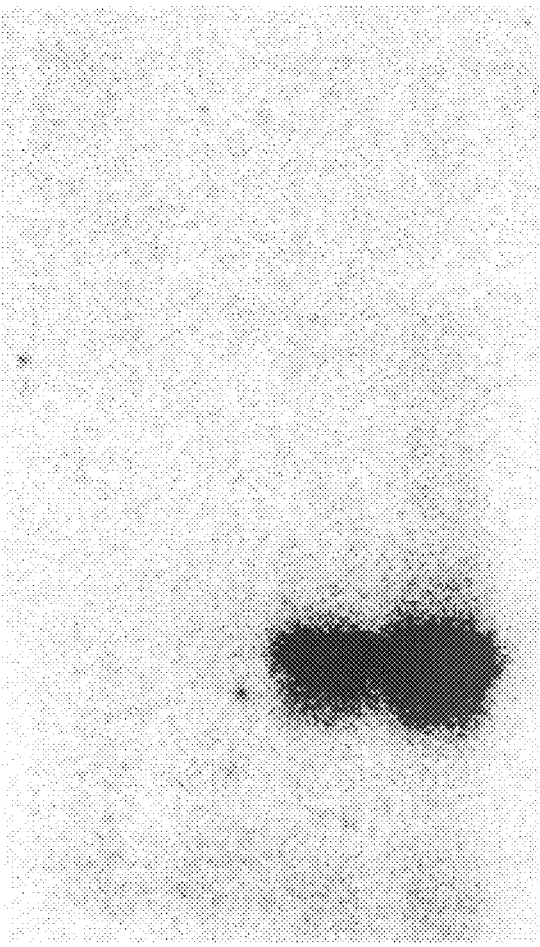
FIG. 41 shows a PhosphoImage (Molecular Dynamics, Sunnyvale, Calif.) of a Southern blot of PCR products generated from a Canadian hepatitis patient after hybridization with radiolabeled from Canadian patient GB-C.5.

GB-C.5 was obtained from a Canadian patient with hepatitis associated aplastic anemia. Each sample from this patient was seropositive in the C.7 ELISA (Example 20). GB-C.5 was detected in the samples obtained from the Canadian patient during aplastic anemia (day 13 post-presentation) and at the time of death (day 14, FIG. 41) using GB-C.5-specific primers (GB-C.5-s1 and GB-C.5-a1). However, GB-C.5-specific PCR failed to detect GB-C.5 sequence at the time of presentation (day 0, acute hepatitis) and on day 3 (liver failure). Thus, it is unclear whether GB-C.5 was present below the limit of detection in the first samples. If so, HGBV-C may have been the causative agent of this patient's aplastic anemia. However, because GB-C.5 was detected by RT-PCR only during aplastic crisis, GB-C.5 may have been acquired from a blood product administered to combat the anemia. In this case, HGBV-C's association with aplastic anemia would be similar to HCV's [Hibbs, et al. *JAMA* 267:2051–2054 (1992)].

Due to the distant relation of HGBV-C and HCV, it was of interest to determine whether current methods for detecting HCV infection would recognize human samples containing HGBV-C. Routine detection of individuals exposed to or infected with HCV relies upon antibody tests which utilize antigens derived from three or more regions of HCV-1. These tests allow detection of antibodies to all of the known genotypes of HCV in most individuals[Sakamoto, et al. *J. Gen. Virol.* 75:1761–1768 (1994); Stuyver, et al. *J. Gen. Virol.* 74:1093–1102 (1993)]. Second generation ELI-SAs for HCV were performed on the samples that contain HGBV-C as described in Example 10 (TABLE 25). One of the 4 samples that contain HGBV-C was seropositive for HCV antigens. A limited number of human sera which are seronegative for HCV have been shown to be positive for HCV genomic RNA by a highly sensitive RT-PCR assay [Sugitani, 1992 #65]. A similar RT-PCR assay (as described in Example 9) confirmed the presence of an HCV viremia in the seropositive sample. However, none of the HCV seronegative samples were HCV viremic. Therefore, although 1 of the 4 individuals containing HGBV-C sequences have evidence of HCV infection, the current assays for the presence of HCV did not accurately predict the presence of HGBV-C. The one HCV-positive patient appears to be co-infected with HGBV-C. It is unclear whether the hepatitis noted in this patient was due to HCV, HGBV-C or the presence of both viruses. That HGBV-C and HCV are found in the same patient may suggest that common risk factors exist for acquiring these infections.

Using the PCR protocol described above, GB-C sequences (~85% identical to the previous GB-C isolates shown in FIG. 41, data not shown) were identified in "normal" units of blood from two volunteer U.S. donor obtained in 1994. These units tested negative for HBV, HCV, and had normal serum ALT values. However, these units tested positive in the 1.4 ELISA. Finding HGBV-C in at least two units of "normal" blood out of ~1000 units immunoscreened suggests that this virus is currently in the U.S. blood supply. However, using ELISAs developed from HGBV proteins and nucleotide probes from HGBV sequences, we demonstrate that these units of blood can be identified.

The large amount of sequence variation in the various GB-C sequences (FIG. 41) should be noted. Although highly sensitive, PCR based assays for viral nucleic acids are dependent on the sequence match between oligonucleotide primers and the viral template. Therefore, because the PCR primers utilized in this study were located in a region of the HGBV-C genome that is not well conserved in various isolates, not all HGBV-C viremic samples tested may have been detected by the RT-PCR assays employed here. Utilization of PCR primers from a highly conserved region of the HGBV-C genome, as have been found in the HCV 5' untranslated region [Cha, et al. *J. Clin. Microbiol.* 29:2528–2534 (1991)], should allow more accurate detection of HGBV-C viremic samples.

TABLE 25

GB-C containing sera

| Sequence | Origin | Clinical | GB reactivity[1] | HCV ELISA[2] | HCV RNA |
|---|---|---|---|---|---|
| GB-C.4 | Egyptian | Acute Hepatitis | A | 0.25 | 0 |
| GB-C.5 | Canada | HA-AA[3] | C | 0.15 | 0 |
| GB-C.6 | U.S. | history of hepatitis | C | 11.51 | + |
| GB-C.7 | U.S. | hepatitis | A | 0.26 | 0 |

[1]Immunoreactivity detected to recombinant HGBV protein(s) from virus A, B or C.
[2]Sample to cutoff values reported. Values ≧1 (underlined) are considered positive.
[3]hepatitis associated aplastic anemia

TABLE 27

| | Egyptian Serial Samples | | |
|---|---|---|---|
| Days post-presentation | ALT (U/l)[1] | 2.17 ELISA Reactivity[2] | GB-C.4 RT-PCR |
| 0 | 128 | 61.0 | + |
| 10 | 78 | 62.9 | + |
| 20 | 49 | 69.4 | + |
| 30 | 33 | 39.1 | + |
| 40 | 30 | 55.9 | + |

[1]Upper limit of normal: 45 U/l.
[2]Sample to normal reported. Values ≧10 are considered positive.

Example 21

Sequence Comparisons and Phylogentic Analysis

Information about the degree of relatedness of viruses can be obtained by performing comparisons, i.e. alignments, of nucleotide and predicted amino acid sequences. Performing alignments of the HGBV sequences with sequences of other viruses can provide a quantitative assessment of the degree of similarity and identity between the sequences. This information can then be used to develop a rationale for the taxonomic classification of the HGBV viruses. In general, the calculation of similarity between two amino acid sequences is based upon the degree of likeness exhibited between the side chains of an amino acid pair in an alignment. The degree of likeness is based upon the physical-chemical characteristics of the amino acid side chains, i.e. size, shape, charge, hydrogen-bonding capacity, and chemical reactivity, thus, similar amino acids possess side chains that have similar physical-chemical characteristics. For example, phenylalanine and tyrosine are amino acids containing aromatic side chains and are, therefore, regarded as chemically similar. A discussion of the chemistry of amino acids can be found in any basic biochemistry textbook, for example, *Biochemistry*, Third Edition, Lubert Stryer, Editor, W. H. Freeman and Company, New York, 1988. The calculation of identity between two aligned amino acid sequences is, in general, an arithmetic calculation which counts the number of identical pairs of amino acids in the alignment and divides this number by the length of the sequence(s) in the alignment. Analogous to the method used for amino acid sequence alignments, the determination of the degree of identity between two aligned nucleotide sequences is an arithmetic calculation which counts the number of identical pairs of nucleotide bases in the alignment and divides this number by the length of the sequence(s) in the alignment. The calculation of similarity between two aligned nucleotide sequences sometimes uses different values for transitions and transversions between paired (i.e. matched) nucleotides at various positions in the alignment; however, the magnitude of the similarity and identity scores between pairs of nucleotide sequences are usually very close, i.e. within one to two percent.

As has been stated earlier, limited identity exists between amino acid sequences of the HGBV agents and hepatitis C genotypes. In order to more accurately determine the degree of relatedness between the HGBV agents and HCV, amino acid sequence alignments were performed using the sequence of the entire large open reading frame (ORF) of HGBV-A, B, and C, and the amino acid sequence of the large ORF of several representative HCV isolates. In addition, the degree of relatedness between the HGBV agents and HCV at the nucleotide level was determined using the entire genomic nucleotide sequence of HGBV-A, B, and C, and that of several representative HCV isolates. Alignment of the amino acid and nucleotide sequences was performed using the program GAP of the Wisconsin Sequence Analysis Package (Version 8) which is available from the Genetics Computer Group, Inc., 575 Science Drive, Madison, Wis., 53711. The gap creation and gap extension penalties were 5.0 and 0.3, respectively, for nucleic acid sequence alignments, and 3.0 and 0.1, respectively, for amino acid sequence comparisons. The GAP program uses the algorithm of Needleman and Wunsch (*J. Mol. Biol.* 48:443–453, 1970) to calculate the degree of similarity and identity, expressed as percentages, between the two sequences being aligned.

The nucleotide and amino acid sequences of selected members of the major hepatitis C virus (HCV) genotypes were obtained from GenBank and are shown below with their respective accession numbers:

TABLE 27

| HCV Isolate | Genotype designation | GenBank Accession Number |
|---|---|---|
| HCV-1 | 1a | M62321 |
| HCV-JK1 | 1b | X61596 |
| HCV-J6 | 2a | D00944 |
| HCV-J8 | 2b | D10988 |
| HCV-K3a | 3a | D28917 |
| HCV-Tr | 3b | D26556 |

Results of pairwise comparisons of the predicted amino acid sequences of the large open reading frame (i.e. putative precursor polyprotein) and the nucleotide sequences between each of the above HCV genotypes and each of the HGBV isolates are shown in Tables 28 and 29, respectively. The genotype designation, which is based on the system of nomenclature for HCV isolates described by Simmonds P. et al (1994) *Hepatology*, 19:1321–1324, of each of the HCV isolates are shown in the top row.

The data shown in TABLE 28 demonstrate that the lower limit of amino acid sequence identity between the HCV genotypes is 69%. This value is very close to that shown by Simmonds et al. [Simmonds, P. et al. *Hepatology*, 19:1321–1324, 1994] who reported that comparisons of the coding region (i.e. large open reading frame) of eight complete HCV genomes from two major groups showed amino acid sequence similarities of 67.1% to 68.6%; however, these authors did not describe the method by which the similarities were calculated. This value (69%) is also very close to the value of 71–84% identity reported by Okomoto et al., [*Virology*, 188:331–341, 1992] for comparisons of HCV-J8 with other major HCV isolates; however, these investigators did not describe the method by which the identities were calculated. Comparisons of the HGBV polyprotein sequences with each of the HCV genotypes reveals that the HGBV-encoded polyprotein sequences exhibit no more than 33% identity to any of the HCV polyproteins (TABLE 28). A comparison of the nucleotide sequences (TABLE 29) demonstrates a maximum sequence identity of 44.2% between any HGBV virus and any HCV isolate, whereas, the minimum nucleotide sequence identity between HCV isolates is 64.9%. Therefore, since HGBV-A, B, and C possess nucleotide and predicted amino acid sequence identity with HCV that is well outside the range of identities established for the known HCV genotypes, the HGBV viruses cannot be considered genotypes of the hepatitis C viruses.

The relationship between the hepatitis C viruses and the hepatitis GB viruses can be examined by performing phylogenetic analysis on their aligned nucleotide or deduced amino acid sequences (i.e. large open reading frames) or on a portion of these sequences. This approach has been applied to the hepatitis C viruses and showed that the variability of HCV isolates delineated six equally divergent main groups of sequences [Simmonds, P. et al., *J. Gen. Virol.* (1993) 74:2391–2399 and Simmonds, P. et al., *J. Gen. Virol.* (1994) 75:1053–1061]. This analysis resulted in the establishment of a system of nomenclature for the hepatitis C viruses [Simmonds, P. et al. *Hepatology*, 19:1321–1324, 1994] where the isolates are classified into genotypes based upon the evolutionary distance between sequences.

In order to determine the phylogenetic relationship between the hepatitis GB viruses and the hepatitis C viruses, alignments of amino acid sequences within the putative helicase gene of NS3 and the putative RNA-dependent RNA-polymerase (RdRp) of NS5B were performed. Also included in the alignments were related sequences from other viruses in the Flaviviridae and viruses that have been shown to possess evolutionary relatedness within their helicase or polymerase genes to members of the Flaviviridae [Koonin, E. V. & Dolja, V. V. (1993) *Crit. Rev. Biochem. Mol. Biol.* 28, 375–430 and Koonin, E. V. (1991) *J. Gen. Virol.* 72, 2179–2206].

Figure 42:
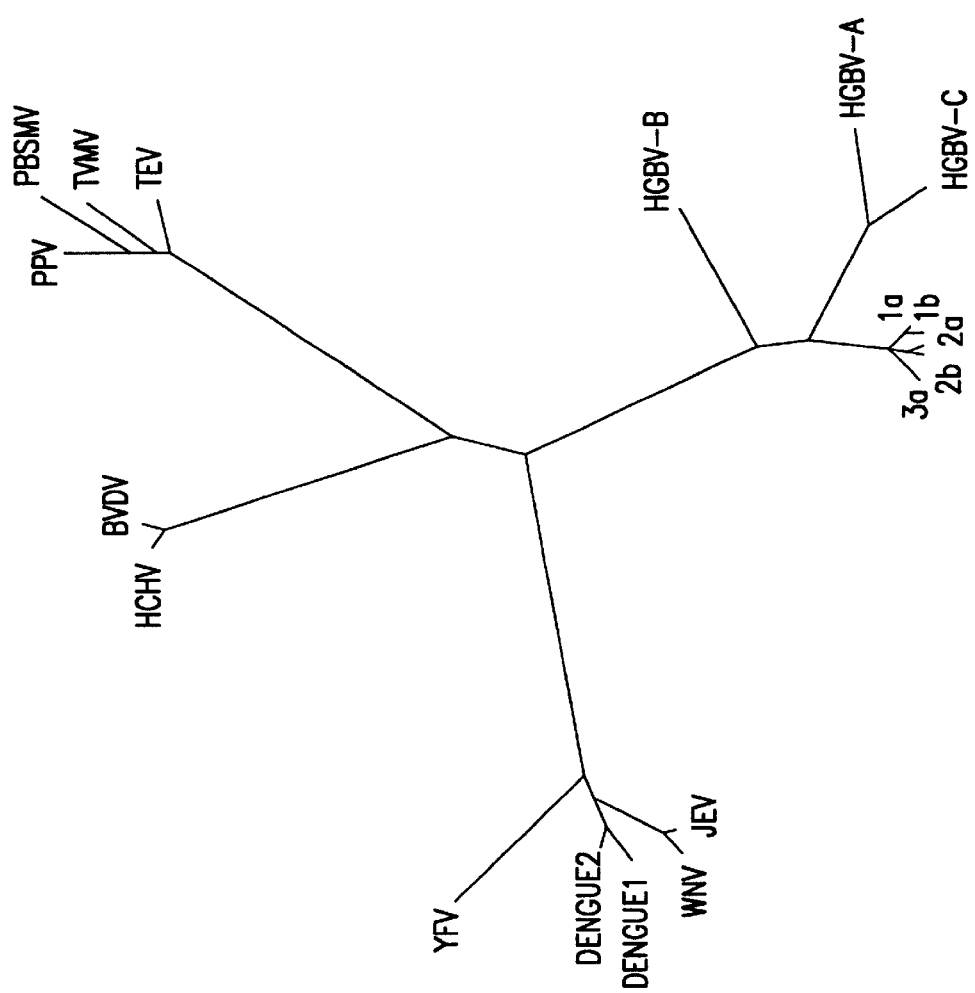
FIG. 42 depicts a phylogenetic tree produced from alignment of the helicase domains of the viruses indicated.
Figure 43:
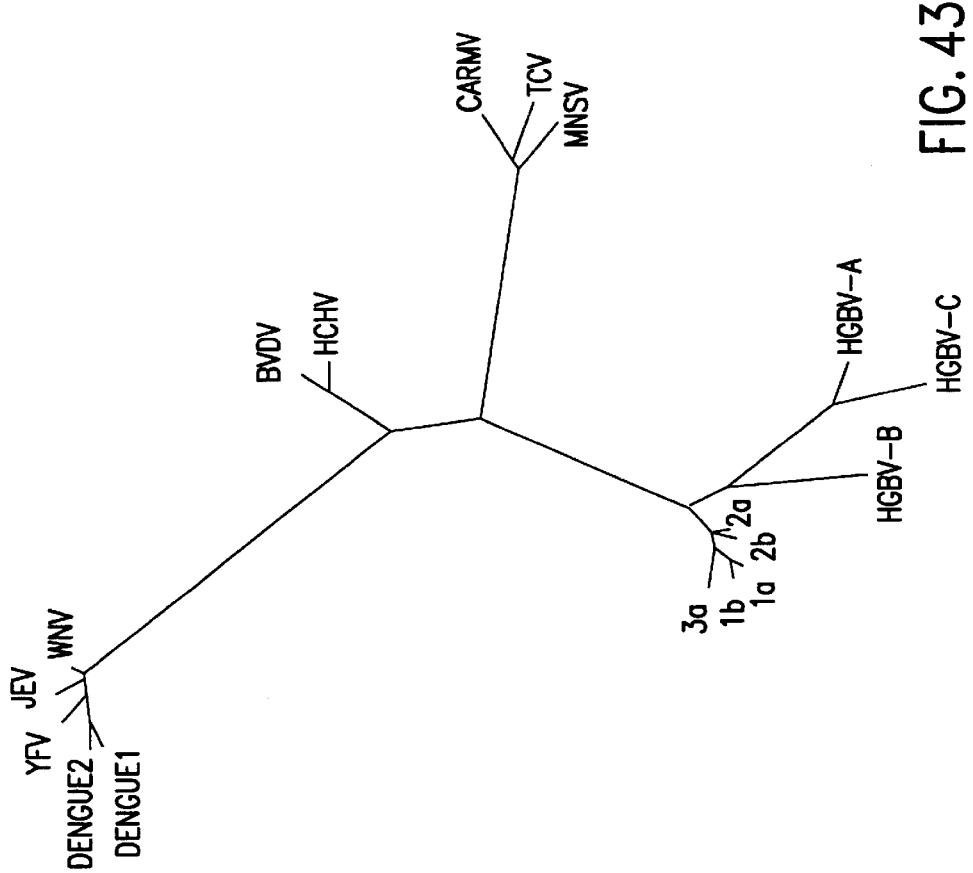
FIG. 43 SCOTT depicts a phylogenetic tree produced from alignment of the RNA-dependent RNA polymerase domains of the viruses indicated.
Figure 44:
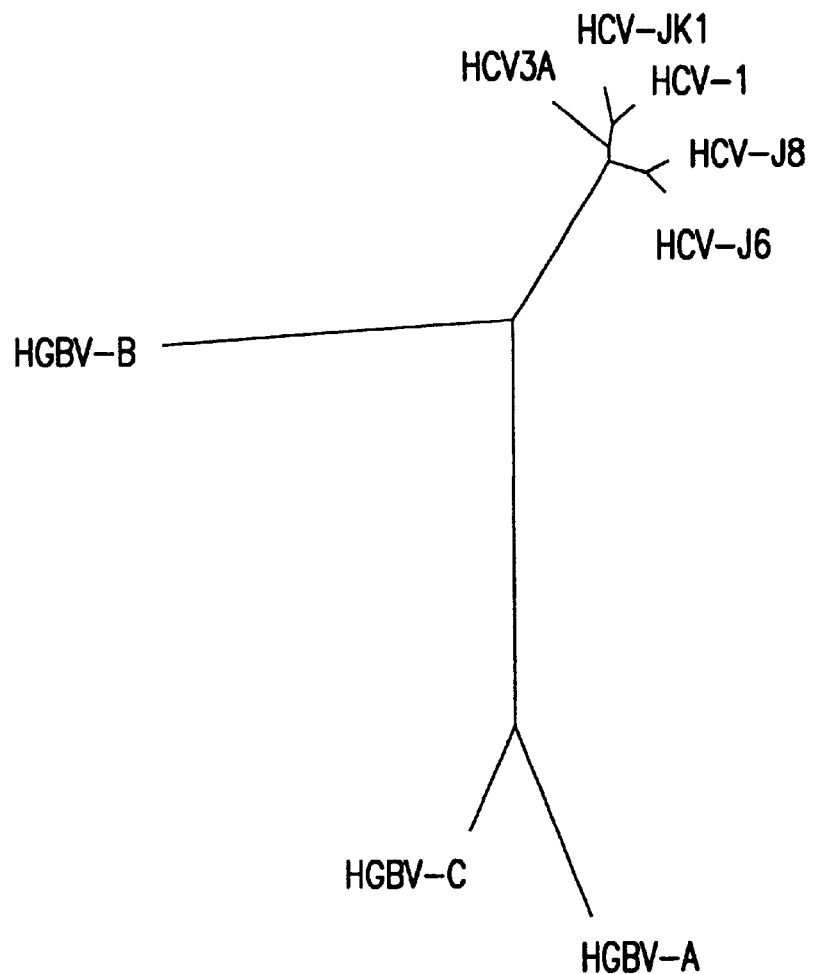
FIG. 44 presents a phylogenetic tree produced from alignment of the large open reading frames (putative precursor polyproteins) of the viruses indicated.

The amino acid sequence alignments were made using the program PILEUP of the Wisconsin Sequence Analysis Package (version 8). Phylogenetic distances between pairs of aligned sequences were determined using the PROTDIST program of the PHYLIP package (version 3.5c, 1993) kindly provided by J. Felsenstein [Felsenstein, J. (1989) *Cladistics* 5:164–166]. These computed distances were used for the construction of phylogenetic trees using the program NEIGHBOR (neighbor-joining setting). The trees were plotted using the program DRAWTREE. The trees shown are not rooted. The viral sequences used and their corresponding GenBank accession numbers are shown in TABLES 31. The evolutionary distance between each HCV genotype and each of the HGBV viruses for alignments made within the helicase, RdRp, or complete large open reading frame are presented below in TABLES 32, 33, and 34 respectively. The distances calculated between the HCV genotypes or the HGBV viruses and the other viruses listed in TABLE 30 are not shown. The phylogenetic trees produced for amino acids alignments of the viral helicases, RdRps, or complete large open reading frames sequences are shown in FIGS. 42, 43 and 44, respectively.

Amino acid sequence alignments of the putative RdRps, encoded within the NS5B region, of HGBV-A, B and C with the RdRp of several HCV genotypes, two of the pestiviruses, several representative flaviviruses, and several positive-strand RNA plant viruses, show that they possess conserved sequence motifs associated with the RdRps of positive-strand RNA viruses (data not shown). Based on similar analyses, the HGBV-A and HGBV-B encoded helicases show significant identity with the helicases of these positive-strand RNA viruses (data not shown), with the exception of CARMV, TCV, and MNSV which presumably do not possess helicase genes [Guilley, H et al. (1985) *Nucleic Acids Res.* 35 13:6663–6677]. These results were not unexpected in view of the association of the helicase and RdRp genes of these viruses into Supergroups demonstrated by previous phylogenetic analyses [Koonin, E. V. & Dolja, V. V. (1993) *Crit. Rev. Biochem. Mol. Biol.* 28, 375–430]. However, examination of the phylogenetic distances between the HGBV isolates and the HCV isolates based upon alignment of the helicase or RdRp sequences (TABLES 30 and 31) demonstrates that there is considerable distance between the members of these two groups. The distances calculated demonstrate the close relationship among the HCV genotypes, where the maximum distance between any two genotypes is 0.3696 (RdRp distance). However, the distances calculated from the RdRp alignment between HGBV-A, -B, or -C and any member of the HCV group is 0.96042–1.46261. Similarly, the distances calculated from the helicase alignments for any two HCV genotype ranges from 0.044555–0.19706, while distances between any member of the HCV group and HGBV-A, -B, or -C ranges from 0.69130–0.87120. In addition, alignment of the predicted amino acid sequence of the entire large open reading frames of the HCV genotype and the GB viruses demonstrates a narrow range of evolutionary distance for the HCV isolates (0.17918–0.39646) while the minimum distance between any GB virus and any HCV isolate is 1.68650. Thus, the hepatitis GB viruses exhibit evolutionary distances that are clearly outside the range demonstrated for the hepatitis C virus genotypes.

The phylogentic analysis of the HGBV and HCV sequences is attempting to answer the question, "How does the divergence of the HGBV sequences from the HCV sequences compare with the divergence among the HCV sequences? In particular, might it be that the HGBV sequences are no more diverged from HCV sequences than the HCV sequences are from one another?" A reasonable condition to be met, if the HGBV sequences were no more diverged from HCV sequences than HCV sequences are from one another, would be that the HGBV-A, HGBV-B, and/or HGBV-C sequences would be at least as close to one of the HCV sequences as the most distantly related pair of HCV sequences (i.e., the minimum distance from any HGBV sequence to any HCV sequence is less than or equal to the maximum observed distance among HCV sequences). This condition is not met by the present sequence data; in Table 31 (RdRp alignment), the minimum HCV-HGBV distance is 2.83 times the maximum HCV-HCV distance; and in Table 32 (helicase alignment), the minimum HCV-HGBV distance is 3.51 times the maximum HCV-HCV distance. Thus, the data do not support the idea that the HGBV sequences are members of a group whose diversity is delimited by previously characterized members of the HCV group.

The distribution of these relative distances can be examined with a test based on the bootstrap [Efron, B. (1982) "The jackknife, the bootstrap, and other resampling plans", *Society Industrial and Applied Mathematics:* Philadelphia; Efron, B. and Gong, G. (1983) "A leisurely look at the bootstrap, the jackknife, and cross-validation." *Am. Stat.* 37: 3648]. The results obtained from the bootstrap sampling are shown in Table 32; which shows the comparison of the HCV-HGBV divergence (minimum of all HCV-HGBV distances) to the HCV diversity (maximum of all HCV-HCV distances) based on PAM distances as calculated using the PROTDIST program. In 1000 bootstrap resamplings of the columns in the sequence alignments, the greatest divergence among HCV sequences was never as large as the smallest of the divergences of the HGBV sequences from the HCV sequences (Table 32). Thus, in independent measurements based on alignments of coding regions from two separate genes, there was not a single instance in which the data were consistent with the HGBV sequences falling within the genetic sequence diversity of HCV genotypes. Leaning in the direction of a conservative estimate, there is less than one chance in 100,000 that the data for the HGBVs could be drawn from the same pool of sequences as the HCV sequences.

TABLE 32

(a) Distances Determined from RdRp AlignmentAlignment
Out of bootstrap 1000 samples:

| | |
|---|---|
| Average min(HCV – HGBV distance)/max(HCV – HCV distance) = | 2.543645 +/– 0.367443 |
| Minimum min(HCV – HGBV distance)/max(HCV – HCV distance) = | 1.617575 |

(b) Distances Determined from Helicase Alignment
Out of bootstrap 1000 samples:

| | |
|---|---|
| Average min(HCV – HGBV distance)/max(HCV – HCV distance) = | 3.346040 +/– 0.511875 |
| Minimum min(HCV – HGBV distance)/max(HCV – HCV distance) = | 2.092055 |

Assuming that the HCV sequences utilized in this study are representative of the most divergent of the HCV genotypes, these results indicate that HGBV-A, B and C are not genotypes of HCV. In addition, it appears that HGBV-A and HGBV-C are more closely related to each other than either is to HGBV-B, which suggests that HGBV-A and HGBV-C may be representatives of a separate viral lineage. Similarly, HGBV-B may be the sole representative of its own viral lineage. The relative evolutionary distances between the viral sequences analyzed are readily apparent upon inspection of the unrooted phylogentic trees presented in FIGS. 45 and 46, where the branch lengths are proportional to the evolutionary distance. The close evolutionary relationship of the HCV viruses is apparent and is consistent whether the analysis is performed using a portion of the encoded genomic sequence or the entire genome (FIG. 44). The large degree of divergence between HGBV-A, HGBV-B, and HGBV-C and other Flaviviridae members demonstrate that, while being most closely related to the hepatitis C viruses, the GB-agents cannot be considered genotypes of HCV and may actually be representatives of a new virus group, or groups, within the Flaviviridae.

The present invention thus provides reagents and methods for determining the presence of HGBV-A, HGBV-B and HGBV-C in a test sample. It is contemplated and within the scope of the present invention that a polynucleotide or polypeptide (or fragment[s] thereof) specific for HGBV-A, HGBV-B and HGBV-C described herein, or antibodies produced from these polypeptides and polynucleotides, can be combined with commonly used assay reagents and incorporated into current assay procedures for the detection of antibody to these viruses. Alternatively, the polynucleotides or polypeptides specific for the HGBV-A, HGBV-B and HGBV-C (or fragment[s] thereof) described herein, or antibodies produced from such polypeptides and polynucleotides (or fragment[s] thereof), can be used separately for detection of the HGBV-A, HGBV-B and HGBV-C viruses.

Other uses or variations of the present invention will be apparent to those of ordinary skill of the art when considering this disclosure. Therefore, the resent invention is intended to be limited only by the appended claims.

TABLE 2

| | T-1048 | | | T-1053 | | | T-1057 | | | T-1061 | | |
|---|---|---|---|---|---|---|---|---|---|---|---|---|
| | ALT | GGT | ICD | ALT | GGT | ICD | ALT | GGT | ICD | ALT | GGT | ICD |
| PRE INOCULATION DAYS PRE | | | | | | | | | | | | |
| 87 | 16 | 7 | | 59 | 12 | | 107 | 4 | | 56 | 4 | |
| 72 | 16 | 8 | 9 | 47 | 10 | 17 | 32 | 19 | 9 | 20 | 7 | 9 |
| 59 | 36 | 8 | 12 | 37 | 10 | 18 | 35 | 7 | 11 | 22 | 5 | 9 |
| 45 | 28 | 5 | 12 | 37 | 8 | 17 | 19 | 4 | 11 | 23 | 5 | 12 |
| 37 | 23 | 5 | 11 | 32 | 8 | 17 | 26 | 8 | 10 | 27 | 6 | 17 |
| 30 | 31 | 5 | 11 | 44 | 10 | 18 | 18 | 7 | 10 | 24 | 6 | 14 |
| 24 | 25 | 5 | 10 | 39 | 9 | 18 | 34 | 3 | 12 | 24 | 7 | 10 |
| 17 | 19 | 4 | 11 | 49 | 10 | 18 | 32 | 7 | 8 | 26 | 7 | 11 |
| 9 | 24 | 6 | 9 | 30 | 7 | 15 | 24 | 12 | 12 | 27 | 8 | 12 |
| 0 | 31 | 6 | 16 | 48 | 4 | 17 | 21 | 9 | 8 | 19 | 2 | 15 |
| POST INOCULATION DAYS POST | | | | | | | | | | | | |
| 7 | 38 | 9 | 15 | 67 | 11 | 29 | 47 | 10 | 13 | 32 | 8 | 12 |
| 11 | | | | 172 | 15 | 53 | | | | | | |
| 14 | 63 | | 39 | Sacrificed | | | 198 | 34 | 90 | 48 | 7 | 16 |
| 21 | 93 | 28 | 57 | | | | 137 | 180 | 22 | 68 | 11 | 42 |
| 28 | 138 | 42 | 71 | | | | 179 | 197 | 45 | 69 | 19 | 34 |
| 35 | 115 | 37 | 64 | | | | 156 | 112 | 26 | 70 | 21 | 8 |
| 42 | 116 | 42 | 76 | | | | 139 | 177 | 54 | 87 | 23 | 61 |
| 49 | 81 | 56 | 34 | | | | 40 | 59 | 16 | 59 | 20 | 41 |
| 56 | 56 | 34 | 42 | | | | 29 | 26 | 12 | 59 | 30 | 45 |
| 63 | 42 | 18 | 25 | | | | 29 | 13 | 11 | 91 | 34 | 60 |
| 77 | 33 | 7 | 15 | | | | 35 | 9 | 12 | 37 | 22 | 29 |
| 84 | 35 | 6 | 17 | | | | 26 | 10 | 12 | 38 | 15 | 23 |
| 91 | 41 | 7 | 19 | | | | 33 | 7 | 12 | 17 | 11 | 14 |
| 97 | 28 | 7 | 20 | | | | 20 | 8 | 10 | 15 | 10 | 9 | GB Challenge |

TABLE 2-continued

| | T-1048 | | | T-1053 | | | T-1057 | | | T-1061 | | |
|---|---|---|---|---|---|---|---|---|---|---|---|---|
| | ALT | GGT | ICD | ALT | GGT | ICD | ALT | GGT | ICD | ALT | GGT | ICD |
| 105 | 36 | 11 | 22 | | | | 46 | 23 | 14 | 20 | 8 | 13 |
| 112 | 28 | 8 | 9 | | | | 30 | 13 | 11 | 19 | 10 | 12 |
| 119 | 35 | 6 | 18 | | | | 27 | 7 | 10 | 24 | 11 | 15 |
| CO | 48.1 | 10.7 | 18.7 | 65.1 | 15.5 | 20.7 | 50.3 | 25.2 | 15.5 | 33.7 | 12.1 | 21.9 |

TABLE 3

| | T-1047 | | | T-1042 | | |
|---|---|---|---|---|---|---|
| | ALT | GGT | ICD | ALT | GGT | ICD |
| PRE INOCULATION DAYS PRE | | | | | | |
| 87 | 79 | 12 | | 99 | 6 | |
| 72 | 40 | 6 | 18 | 27 | 4 | 8 |
| 59 | 48 | 5 | 20 | 37 | 6 | 8 |
| 45 | 60 | 10 | 19 | 24 | 5 | 8 |
| 37 | | | | 40 | 7 | 11 |
| 30 | 47 | 8 | 26 | 39 | 4 | 10 |
| 24 | | | | 25 | 2 | 11 |
| 17 | 54 | 12 | 27 | 33 | 5 | 12 |
| 9 | | | | 44 | 5 | 11 |
| 0 | 43 | 12 | 18 | 33 | 5 | 12 |
| POST INOCULATION DAYS POST | | | | | | |
| 7 | 33 | 10 | 15 | 30 | 6 | 9 |
| 11 | | | | | | |
| 14 | 49 | 9 | 18 | 32 | 6 | 8 |
| 21 | 33 | 6 | 13 | 48 | 8 | 12 |
| 28 | 38 | 7 | 12 | 28 | 5 | 11 |
| 35 | 44 | 8 | 15 | 38 | 7 | 11 |
| 42 | 38 | 8 | 14 | 31 | 9 | 11 |
| 49 | 52 | 8 | 16 | 28 | 7 | 9 |
| 56 | 41 | 9 | 15 | 21 | 6 | 11 |
| CO | 73.7 | 19.1 | 35.3 | 58.6 | 9.7 | 16.1 |

TABLE 4

| | T-1044 | | | T-1034 | | |
|---|---|---|---|---|---|---|
| | ALT | GGT | ICD | ALT | GGT | ICD |
| PRE INOCULATION DAYS PRE | | | | | | |
| 87 | 102 | 6 | | 97 | | |
| 72 | 19 | 5 | 11 | 42 | 6 | 12 |
| 59 | 23 | 6 | 11 | 12 | 11 | 12 |
| 45 | 37 | 6 | 12 | 32 | 6 | 10 |
| 37 | 37 | 6 | 15 | 21 | 6 | 22 |
| 30 | 41 | 7 | 24 | 29 | 6 | 23 |
| 24 | 27 | 5 | 12 | 22 | 8 | 15 |
| 17 | 22 | 6 | 10 | 26 | 10 | 12 |
| 9 | 31 | 4 | 12 | 30 | 4 | 11 |
| 0 | 40 | 4 | 14 | 19 | 3 | 17 |
| POST INOCULATION DAYS POST | | | | | | |
| 7 | 34 | 6 | 14 | 27 | 8 | 13 |
| 11 | | | | | | |
| 14 | 39 | 8 | 16 | 28 | 12 | 13 |
| 21 | 36 | 6 | 10 | 21 | 8 | 16 |
| 28 | 37 | 6 | 9 | 14 | 9 | 13 |
| 35 | 35 | 5 | 10 | 19 | 9 | 12 |
| 42 | 27 | 4 | 9 | 32 | 8 | 13 |
| 49 | 59 | 7 | 13 | 33 | 7 | 14 |
| 56 | 24 | 4 | 12 | 30 | 9 | 12 |
| 63 | 30 | 5 | 11 | 31 | 9 | 12 |
| 67 | 21 | 7 | 9 | 39 | 11 | 10 |
| CO | 60.3 | 9.0 | 28.5 | 56.6 | 15.9 | 31.9 |

TABLE 5

| | T-1038 | | | T-1049 | | | T-1051 | | | T-1055 | | |
|---|---|---|---|---|---|---|---|---|---|---|---|---|
| | ALT | CGT | ICD | ALT | CGT | ICD | ALT | CGT | ICD | ALT | CGT | ICD |
| PRE INOCULATION DAYS PRE | | | | | | | | | | | | |
| 115 | 82 | 9 | | 102 | 13 | | 41 | 15 | | 97 | 34 | |
| 100 | 42 | 4 | 15 | 23 | 9 | 9 | 31 | 6 | 13 | 30 | 3 | 9 |
| 87 | 30 | 8 | 13 | 28 | 7 | 12 | | | | 41 | 6 | 11 |
| 73 | 45 | 5 | 16 | 68 | 10 | 27 | | | | 44 | 4 | 12 |
| 65 | | | | | | | | | | | | |
| 58 | 29 | 9 | 15 | 22 | 6 | 15 | 23 | 10 | 16 | 35 | 6 | 14 |
| 52 | | | | | | | | | | | | |
| 45 | 48 | 8 | 17 | 49 | 9 | 16 | 23 | 13 | 13 | 27 | 8 | 11 |
| 37 | | | | | | | | | | | | |
| 31 | 41 | 14 | 12 | 28 | 7 | 14 | 26 | 7 | 12 | 24 | 3 | 10 |
| 28 | | | | | | | | | | | | |

TABLE 5-continued

| | T-1038 | | | T-1049 | | | T-1051 | | | T-1055 | | |
|---|---|---|---|---|---|---|---|---|---|---|---|---|
| | ALT | CGT | ICD | ALT | CGT | ICD | ALT | CGT | ICD | ALT | CGT | ICD |
| 16 | | | | 30 | 9 | 14 | 29 | 9 | 13 | 15 | 5 | 8 |
| 0 | 32 | 16 | 10 | 24 | 6 | 15 | 27 | 9 | 11 | 23 | 7 | 10 |
| POST INOCULATION | | | | | | | | | | | | |
| DAYS POST | | | | | | | | | | | | |
| 7 | 30 | 12 | 10 | 42 | 5 | 15 | 27 | 6 | 18 | 150 | 11 | 21 |
| 11 | 81 | 18 | 42 | 79 | 15 | 33 | 66 | 13 | 42 | 161 | 19 | 50 |
| 14 | 178 | 24 | 77 | 123 | 21 | 86 | 78 | 14 | 35 | | | |
| | | sacrificed | | | sacrificed | | | | | | sacrificed | |
| 21 | | | | | | | 108 | 18 | 60 | | | |
| 28 | | | | | | | 308 | 53 | 39 | | | |
| 35 | | | | | | | 273 | 108 | 56 | | | |
| 49 | | | | | | | 84 | 27 | 34 | | | |
| 56 | | | | | | | 66 | 28 | 34 | | | |
| 63 | | | | | | | 72 | 28 | 29 | | | |
| 69 | | | | | | | 41 | 18 | 19 | | | |
| 76 | | | | | | | 28 | 11 | 13 | | | |
| 83 | | | | | | | 44 | 12 | 15 | | | |
| 90 | | | | | | | 43 | 7 | 16 | | | |
| CO | 66.2 | 20.1 | 21.0 | 94.2 | 13.2 | 34.9 | 38.4 | 18.2 | 18.5 | 65.8 | 11.3 | 17.6 |

TABLE 8

HGBV CLONES

| | | | | Tamarin Plasma[d] | | | | | |
|---|---|---|---|---|---|---|---|---|---|
| | | | Genomic | Pre-inoculation | | Acute Phase | | | |
| Clone | size[a] | Southern[b] | PCR[c] | PCR | RT-PCR | PCR | RT-PCR | H205[e] | Northern[f] |
| 2 | 737 bp | neg. | ND | 0/1 | 0/1 | 0/1 | 1/1 | + | ND |
| 4 | 221 bp | ND[g] | neg. | ND | 0/1 | 0/1 | 1/1 | + | ≧7 kb |
| 10 | 307 bp | ND | neg. | ND | 0/1 | 0/1 | 1/1 | + | ND |
| 16 | 532 bp | neg. | neg. | 0/1 | 0/7 | 0/1 | 4/6 | + | ND |
| 18 | 306 bp | ND | neg. | ND | 0/1 | 0/1 | 1/1 | + | ND |
| 23 | 369 bp | ND | ND | ND | 0/1 | ND | 1/1 | + | ND |
| 50 | 337 bp | ND | neg. | ND | 0/1 | 0/1 | 1/1 | + | ≧7 kb |

[a]size of clone in base pairs (bp).
[b]Southern blot analysis of tamarin, human, yeast and *E. coli* genomic DNA using GB clone sequence as a probe. Negative (neg.) indicates that clone did not hybridize with any of the genomic DNAs tested.
[c]Genomic PCR was performed on tamarin, human yeast and *E. coli* DNAs with primers that amplify the cloned sequence. Neg. indicates that the clone was not amplified from the DNA sources tested.
[d]Tamarin plasmas, both pre-HGBV-inoculation (pre-inoc.) and acute phase (acute) were tested for the presence of cloned sequence by PCR (to detect DNA sequences) or RT-PCR (to detect RNA and DNA sequences). The results are reported as the number of PCR-positive samples per number of samples examined.
[e]H205 was tested for the presence of the clones by RT-PCR. All clones were RT-PCR positive (+) in H205 source.
[f]Northern blot analysis was performed on total liver RNA from normal tamarin liver and acute phase tamarin liver using radiolabel clone sequences. The estimated size of the specific band detected in the acute phase liver RNA is given.
[g]ND: not determined.

TABLE 12

| | Days Pre (−) | CORZYME | | HAVAB | | HCV 2.0 | | HEV | |
|---|---|---|---|---|---|---|---|---|---|
| Sera | or Post (+) Inoculation | A492 c/o = 0.582* | Result | A492 c/o = 0.662** | Result | A492 c/o = 0.408*** | S/N | A492 c/o = >6**** | S/N |
| Control Sera | | | | | | | | | |
| HuN/C | | 1.397 | − | 1.295 | − | 0.070 | − | 0.038 | − |
| HuP/C | | 0.036 | + | 0.030 | + | 1.352 | + | 1.932 | + |
| Tamarin Sera | | | | | | | | | |
| T1048 pre | −44 | N.D | N.D | N.D | N.D | N.D | N.D | 0.007 | 1.47 |
| T1048 pre | −23 | 0.912 | − | 1.834 | − | 0.023 | − | N.D | N.D |
| T1048 post | +112 | 1.148 | − | 1.387 | − | 0.025 | − | 0.026 | 0.68 |

TABLE 12-continued

| Sera | Days Pre (−) or Post (+) Inoculation | CORZYME A492 c/o = 0.582* | CORZYME Result | HAVAB A492 c/o = 0.662** | HAVAB Result | HCV 2.0 A492 c/o = 0.408*** | HCV 2.0 S/N | HEV A492 c/o = >6**** | HEV S/N |
|---|---|---|---|---|---|---|---|---|---|
| T1051 pre | −52 | N.D | N.D | N.D | N.D | N.D. | N.D | 0.019 | 0.50 |
| T1051 pre | −8 | 0.548 | + | 1.465 | − | 0.035 | − | N.D | N.D |
| T1051 post | +76 | 0.700 | − | 1.559 | − | 0.043 | − | 0.029 | 0.76 |
| T1057 pre | −30 | N.D | N.D | N.D | N.D | N.D | N.D | 0.016 | 0.42 |
| T1057 pre | −23 | 0.369 | + | 1.411 | − | 0.029 | − | N.D | N.D |
| T1057 post | +49 | N.D | N.D | N.D | N.D | N.D | N.D | 0.017 | 0.45 |
| T1057 post | +77 | 0.580 | + | 1.444 | − | 0.028 | − | N.D | N.D |
| T1061 pre | −30 | N.D | N.D | N.D | N.D | N.D | N.D | 0.102 | 2.68 |
| T1061 pre | −23 | 0.248 | + | 0.029 | + | 0.040 | − | N.D | N.D |
| T1061 post | +112 | 0.240 | + | 0.048 | + | 0.030 | − | 0.077 | 2.03 |

*Cutoff was determined: 0.4 × N/Cx + 0.6 × P/Cx
**Cutoff was determined: N/Cx + P/Cx / 2
***Cutoff was determined: N/Cx + 25% P/C
****Cutoff was determined: S/N > 6

TABLE 14

HGBV-A Samples

| PCR product[a] | Restriction digest[b] | Reactivity with T1048 + T1051 sera | Reactivity with GB serum | Reactivity with G1-41 serum | Reactivity with G1-14 serum | Reactivity with G1-31 serum | Reactivity with 341C serum |
|---|---|---|---|---|---|---|---|
| 1.2 | EcoRI, PstI | − | − | − | − | − | − |
| 1.5 | EcoRI, HindIII | − | − | + | − | − | − |
| 1.8 | KpnI, PstI | − | − | − | − | − | − |
| 1.17 | KpnI, PstI | − | − | ND | ND | − | − |
| 1.18 | KpnI, PstI | − | − | ND | ND | + | + |
| 1.19 | KpnI, PstI | − | − | ND | ND | − | + |
| 1.20 | KpnI, PstI | − | − | ND | ND | − | − |
| 1.21 | XbaI, BamHI | − | − | ND | ND | − | − |
| 1.22 | KpnI, PstI | − | + | ND | ND | − | − |
| 1.23 | KpnI, PstI | − | − | ND | ND | − | − |
| 2.17 | BamHI, SphI | − | + | ND | ND | + | + |
| 2.18 | KpnI, PstI | − | − | ND | ND | − | − |
| 4.2 | EcoRI, blunt | − | − | ND | ND | − | − |

[a]PCR product is as indicated in Table 9, Table 10, or Example 13.
[b]Restriction digests used to liberate the PCR fragment from pT7Blue T-vector or for direct digestion of 4.2 PCR product.
ND = not done.

TABLE 16

SEROLOGIC RESULTS HGBV-B

| CATEGORY | SPECIMENS | POS/TOTAL 1.4 ELISA* | POS/TOTAL 4.1 ELISA* | POS/TOTAL 1.7 ELISA* | TOTAL |
|---|---|---|---|---|---|
| Individuals Assumed "Low Risk" for HGBV Exposure | Volunteer Blood Donors | | | | |
|  | 1 | 0/200 | 0/200 | 0/200 | 0/200 |
|  | 2 | 4/200 | | | 4/200 |
|  | Interstate Blood Bank | 9/760 | ND** | 0/760 | 9/760 |
| Individuals Assumed "At Risk" for HGBV Exposure | Intravenous Drug Users | | | | |
|  | 1 | 3/112 | 5/112 | 3/112 | 9/112 |
|  | 2 | 1/99 | 0/99 | 0/99 | 1/99 |
|  | Western Africa | 91/1300 | 51/1300 | 43/1300 | 181/1300 |
|  | Hemophiliacs | 2/100 | ND | 1/100 | 2/100 |
| Individuals with "Non A–E Hepatitis" | Clinics in Japan | 0/180 | 7/89 | 2/180 | 9/180 |
|  | Clinics in Greece | 4/73 | 0/67 | 3/73 | 5/73 |
|  | Clinics in U.S. (SET M) | 1/72 | 2/72 | 3/72 | 4/72 |
|  | Clinics in U.S. (SET T) | 0/64 | 0/64 | 0/64 | 0/64 |
|  | Clinics in U.S. | 0/62 | 2/62 | 2/62 | 3/62 |
|  | Clinics in Egypt | 9/132 | 1/132 | 9/132 | 11/132 |
|  | Clinics in New Zealand | 2/56 | 1/56 | 1/56 | 4/56 |

TABLE 16-continued

SEROLOGIC RESULTS HGBV-B

| | | POS/TOTAL | | | |
|---|---|---|---|---|---|
| CATEGORY | SPECIMENS | 1.4 ELISA* | 4.1 ELISA* | 1.7 ELISA* | TOTAL |
| | Clinics in Costa Rica | 2/100 | ND | 1/100 | 2/100 |
| | Clinics in Pakistan | 2/82 | ND | 2/82 | 4/82 |
| | Clinics in Italy | 0/10 | 0/10 | 0/10 | 0/10 |
| | Clinics in U.S. SET 1 | 0/56 | ND** | 0/56 | 0/56 |
| | SET 2 | 0/20 | ND** | 0/20 | 0/20 |
| | SET 3 | 3/51 | ND** | 1/51 | 3/51 |

TABLE 17

HGBV-B Serological Results

| | Repeatably Reactive 1.4, 1.7 or 4.1 ELISA | Negative In 1.4, 1.7 or 4.1 ELISA | $X^{2*}$ | SIG** |
|---|---|---|---|---|
| Volunteer Blood Donors | 0 | 200 | — | — |
| IBB Ohio | 9 | 751 | — | ???* |
| Intravenous Drug Users (US) | 1 | 99 | — | NS* |
| | 9 | 103 | | ??? |
| West Africa | 181 | 1119 | | ???• |
| Clinics in Japan | 4 | 81 | — | ???* |
| Clinics in New Zealand | 4 | 52 | — | ???* |
| Clinics in Greece | 1 | 10 | — | ???* |
| Clinics in Egypt | 5 | 20 | — | ???* |

TABLE 17-continued

HGBV-B Serological Results

| | Repeatably Reactive 1.4, 1.7 or 4.1 ELISA | Negative In 1.4, 1.7 or 4.1 ELISA | $X^{2*}$ | SIG** |
|---|---|---|---|---|
| in U.S. | | | | |
| Set 1 | 0 | 56 | | NS* |
| Set 2 | 0 | 20 | | NS* |
| Set 3 | 3 | 51 | | ??? |
| Set M | 4 | 68 | | ???? |
| Set T | 0 | 64 | | NS* |
| Assumed Low Risk | 0 | 200 | — | — |
| Paid Blood Donors | 9 | 751 | | ??? |
| Assumed High Risk | 191 | 1321 | | •?? |
| Non A–E Hepatitis | 21 | 431 | — | NS* |

*Chi square value obtained by applying the Chi square test.
**Determination of statistical significance based upon the Chi square analysis.
†Not statistically significant by the Chi square test.
•Statistically significant by the Chi square test, with p < 0.050.

TABLE 18

SEROLOGIC RESULTS-TABLE A

| | | POS/TOTAL | | | | |
|---|---|---|---|---|---|---|
| CATEGORY | SPECIMENS | 1.18 ELISA | 2.17 ELISA | 1.22 ELISA | 1.5 ELISA | TOTAL REACTIVE |
| Individuals Assumed "Low Risk" for HGBV Exposure | Volunteer Blood Donors 1 2 | 0/200 | 1/200 | 0/200 | 0/200 | 1/200 |
| | Interstate Blood Bank | ND* | ND | ND | 0/760 | 0/760 |
| Individuals Assumed "At Risk" for HGBV Exposure Individuals with "Non A–E Hepatitis" | Intravenous Drug Users | 1/112 | 1/112 | 0/112 | 0/112 | 2/112 |
| | Western Africa | 9/353 | 43/817 | 6/817 | 58/1300 | 91/1300 |
| | Clinics in Japan | 0/89 | 1/89 | ND | 4/89 | 3/89 |
| | Clinics in Greece | 0/67 | 0/67 | 0/67 | 0/67 | 0/67 |
| | Clinics in (Mayo) | 3/72 | 2/72 | 4/72 | 0/72 | 7/72 |
| | Clinics in U.S. (Thiele) | 0/64 | 0/64 | 0/64 | 0/64 | 1/64 |
| | Clinics in U.S. (1/3) | 1/62 | 2/62 | 2/62 | 0/62 | 3/62 |
| | Clinics in Egypt | 0/132 | 7/132 | 0/132 | 0/132 | 7/132 |
| | Clinics in New Zealand | ND | ND | ND | 0/56 | ND |

*Separate ELISA's were developed and cutoffs determined
**Not Done

TABLE 19

HGBV-A Serological Results

| | Repeatably Reactive in 1.18, 2.17, 1.22, or 1.5 ELISA | Negative In 1.18, 2.17, 1.22, or 1.5 ELISA | $X^{2*}$ | SIG** |
|---|---|---|---|---|
| Volunteer Blood Donors | 1 | 199 | — | — |
| IBB Ohio | 0 | 760 | — | NS* |
| Intravenous Drug Users (US) | 2 | 110 | — | NS* |
| West Africa | 91 | 1209 | — | ???• |
| Clinics in Japan | 2 | 83 | — | ???* |
| Clinics in New Zealand | 0 | 56 | — | NS* |
| Clinics in Greece | 0 | 11 | — | NS* |
| Clinics in Egypt | 3 | 22 | — | ???* |
| in U.S. | | | | |
| Set 1 | ND | ND | — | — |
| Set 2 | ND | ND | — | — |
| Set 3 | ND | ND | — | — |
| Set M | 7 | 65 | — | ??? |
| Set T | 1 | 63 | — | ??? |
| Assumed Low Risk | 1 | 200 | — | — |
| Paid Blood Donors | 0 | 760 | — | NS* |
| Assumed High Risk | 93 | 1319 | — | ???• |
| Non A–E Hepatitis | 13 | 300 | — | ?????* |

*Chi square value obtained by applying the Chi square test.
**Determination of statistical significance based upon the Chi square analysis.
†Not statistically significant by the Chi square test.
•Statistically significant by the Chi square test, with p < 0.050.

TABLE 23

SEROLOGIC RESULTS HGBV-C

| | | POS/TOTAL | | | |
|---|---|---|---|---|---|
| CATEGORY | SPECIMENS | C.7 ELISA* | C.1 ELISA* | C.6 ELISA* | TOTAL |
| Individuals Assumed "Low Risk" for HGBV Exposure | Volunteer Blood Donors 1 | 0/200 | 1/200 | 3/200 | 4/200 |
| | 2 Interstate Blood Bank | ND** | ND** | ND** | ND** |
| Individuals Assumes "At Risk" for HGBV Exposure | Intravenous Drug Users | 1/112 | 1/112 | 0/112 | 2/112 |
| | Western Africa | 5/137 | 12/97 | 3/52 | 20/137 |
| Individuals with "Non A–E Hepatitis" | Clinics in Japan | ND** | 0/89 | ND** | 0/89 |
| | Clinics in Greece | 0/67 | 0/67 | ND** | 0/67 |
| | Clinics in U.S. (SET M) | 0/72 | 2/72 | 4/72 | 6/72 |
| | Clinics in U.S. (SET T) | 1/64 | 0/64 | 0/64 | 1/64 |
| | Clinics in U.S. (SET 1/3) | 2/62 | 1/62 | 1/62 | 3/62 |
| | Clinics in Egypt | 3/132 | 0/132 | 15/132 | 18/132 |
| | Clinics in New Zealand | ND** | ND** | ND** | ND** |

TABLE 24

HGBV-C Serological Results

| | Repeatably Reactive in C.1, C.6, or C.7 ELISA | Negative In C.1, C.6, or C.7 ELISA | $X^{2*}$ | SIG** |
|---|---|---|---|---|
| Volunteer Blood Donors | 4 | 196 | — | — |
| IBB Ohio | ND | ND | — | NS* |
| Intravenous Drug Users (US) | 2 | 110 | — | NS* |
| West Africa | 20 | 117 | — | ???? |
| Clinics in Japan | 0 | 85 | — | NS* |
| Clinics in New Zealand | ND | ND | — | NS* |
| Clinics in Greece | 0 | 11 | — | NS* |
| Clinics in Egypt | 6 | 19 | — | ???? |
| in U.S. | | | | |
| Set 1/3 | 3 | 59 | | ???? |
| Set M | 6 | 66 | | ??? |
| Set T | 1 | 63 | | NS* |
| Assumed Low Risk | 0 | 200 | — | — |
| Paid Blood Donors | 9 | 751 | | ??? |
| Assumed High Risk | 191 | 1330 | | ???• |
| Non A–E Hepatitis | 21 | 303 | — | ???* |

*Chi square value obtained by applying the Chi square test.
**Determination of statistical significance based upon the Chi square analysis.
†Not statistically significant by the Chi square test.
•Statistically significant by the Chi square test, with p < 0.050.

TABLE 28

Amino acid sequence similarity (identity) across large ORFs (%).

| genotype:<br>isolate: | 1a<br>HCV-1 | 1a<br>JK1 | 1b<br>J6 | 2a<br>J8 | 2b<br>K3A | 3a<br>Tr | 3b<br>HGBV-A | HGBV-B |
|---|---|---|---|---|---|---|---|---|
| HCV-JK1 | 91 (85) | | | | | | | |
| HCV-J6 | 84 (72) | 83 (72) | | | | | | |
| HCV-J8 | 84 (72) | 83 (71) | 92 (84) | | | | | |
| HCV-K3A | 85 (74) | 84 (75) | 91 (84) | 82 (70) | | | | |
| HCV-Tr | 84 (74) | 84 (73) | 82 (69) | 81 (69) | 91 (84) | | | |
| HGBV-A | 49 (26) | 52 (31) | 49 (28) | 50 (28) | 48 (26) | 47 (27) | | |
| HGBV-B | 52 (32) | 49 (27) | 52 (33) | 52 (33) | 50 (31) | 50 (31) | 49 (27) | |
| HGBV-C | 51 (29) | 49 (27) | 51 (28) | 50 (28) | 51 (29) | 50 (28) | 66 (48) | 51 (28) |

TABLE 29

Nucleotide sequence identity across entire genomes (%)

| genotype:<br>isolate: | 1a<br>HCV-1 | 1a<br>JK1 | 1b<br>J6 | 2a<br>J8 | 2b<br>K3A | 3a<br>Tr | 3b<br>HGBV-A | HGBV-B |
|---|---|---|---|---|---|---|---|---|
| HCV-JK1 | 78.8 | | | | | | | |
| HCV-J6 | 67.8 | 68.0 | | | | | | |
| HCV-J8 | 67.3 | 67.2 | 77.0 | | | | | |
| HCV-K3A | 68.6 | 69.1 | 65.9 | 65.2 | | | | |
| HCV-Tr | 68.3 | 68.4 | 65.1 | 64.9 | 77.5 | | | |
| HGBV-A | 41.6 | 41.8 | 41.5 | 41.0 | 41.6 | 41.6 | | |
| HGBV-B | 43.8 | 43.4 | 44.2 | 43.3 | 43.5 | 43.1 | 42.6 | |
| HGBV-C | 42.9 | 42.3 | 42.1 | 42.1 | 41.1 | 41.5 | 53.3 | 41.6 |

TABLE 30

GenBank Accession numbers

| Virus | GenBank Accession Number |
|---|---|
| HCV-1 | M62321 |
| HCV-JK1 | X61596 |
| HCV-J6 | D00944 |
| HCV-J8 | D10988 |
| HCV-Tr | D26556 |
| Dengue 1 | M87512 |
| Dengue 2 | M29095 |
| BVDV, Bovine viral diahhrea virus | M31182 |
| HCHV, Hog cholera virus | J04358 |
| WNV, West nile virus | M12294 |
| YFV, Yellow fever virus | X15062 |

TABLE 30-continued

GenBank Accession numbers

| Virus | GenBank Accession Number |
|---|---|
| JEV, Japanese encephalitis virus | M18370 |
| CARMV, Carnation mottle virus | X02986 |
| TCV, Turnip crinkle virus | M22445 |
| MNSV, Melon necrotic spot virus | D12536 |
| PBMSV, Pea seed-borne mosaic virus | D10930 |
| PPV, Plum pox virus | X16415 |
| TVMV, Tobacco vien mottling virus | X04083 |
| TEV, Tobacco etch virus | M15239 |

TABLE 31

Evolutionary distances: RdRp sequences.

| | HGBV-A | HGBV-C | HCV-J6 | HCV-J8 | HCV-1 | HCV-JK1 | HCV-3A |
|---|---|---|---|---|---|---|---|
| HGBV-C | 0.54878 | | | | | | |
| HCV-J6 | 1.14632 | 1.43972 | | | | | |
| HCV-J8 | 1.16398 | 1.43043 | 0.11550 | | | | |
| HCV-1 | 1.25705 | 1.36554 | 0.26824 | 0.26864 | | | |
| HCV-JK1 | 1.23506 | 1.46261 | 0.29041 | 0.29207 | 0.11347 | | |
| HCV-3A | 1.26876 | 1.40316 | 0.34880 | 0.36960 | 0.30535 | 0.35182 | |
| HGBV-B | 1.14880 | 1.31596 | 1.00961 | 0.96402 | 1.07379 | 1.04486 | 1.01997 |

TABLE 32

Evolutionary distances: helecase sequences.

|  | HGBV-A | HGBV-C | HCV1 | HCVJK1 | HCVJ6 | HCVJ8 | HCV3A |
|---|---|---|---|---|---|---|---|
| HGBV-C | 0.42074 | | | | | | |
| HCV-1 | 0.86162 | 0.71571 | | | | | |
| HCV-JK1 | 0.87120 | 0.71731 | 0.04455 | | | | |
| HCV-J6 | 0.85757 | 0.73261 | 0.14090 | 0.14079 | | | |
| HCV-J8 | 0.83480 | 0.72594 | 0.14200 | 0.14779 | 0.07495 | | |
| HCV-3A | 0.86537 | 0.77858 | 0.18703 | 0.19706 | 0.16267 | 0.17985 | |
| HGBV-B | 1.02224 | 0.92174 | 0.72260 | 0.71806 | 0.72050 | 0.69130 | 0.73171 |

TABLE 33

Evolutionary distances: complete large open reading frames.

|  | HGBV-A | HGBV-C | HCVJ6 | HCVJ8 | HCV1 | HCVJK1 | HCV3A |
|---|---|---|---|---|---|---|---|
| HGBV-C | 0.92796 | | | | | | |
| HCV-J6 | 2.41182 | 2.14894 | | | | | |
| HCV-J8 | 2.41162 | 2.16319 | 0.17918 | | | | |
| HCV-1 | 2.38813 | 2.11644 | 0.35897 | 0.36481 | | | |
| HCV-JK1 | 2.40833 | 2.12664 | 0.36577 | 0.37948 | 0.17411 | | |
| HCV-3A | 2.44255 | 2.15842 | 0.38848 | 0.39646 | 0.32500 | 0.32271 | |
| HGBV-B | 2.68767 | 2.47039 | 1.69983 | 1.68650 | 1.71216 | 1.71657 | 1.73779 |

SEQUENCE LISTING (716 sequences)

SEQ ID NO: 1 - DNA (genomic), 24 bp; single-stranded, linear
agcactctccagcctctcaccgca

SEQ ID NO: 2 - DNA (genomic), 12 bp; single-stranded, linear
gatctgcggtga

SEQ ID NO: 3 - DNA (genomic), 24 bp; single-stranded, linear
aggcaactgtgctatccgagggaa

SEQ ID NO: 4 - DNA (genomic), 12 bp; single-stranded, linear
gatcttccctcg

SEQ ID NO: 5 - DNA (genomic), 24 bp; single-stranded, linear
accgacgtcgactatccatgaaca

SEQ ID NO: 6 - DNA (genomic), 12 bp; single-stranded, linear
gatctgttcatg

SEQ ID NO: 7 - DNA (genomic), 18 bp; single-stranded, linear
ggaattcgcggccgctcg

SEQ ID NO: 8 - DNA (genomic), 20 bp; single-stranded, linear
cgagcggccgcgaattcctt

SEQ ID NO: 9 - DNA (genomic), 24 bp; single-stranded, linear
ttgacaccagaccaactggtaatg

SEQ ID NO: 10 - DNA (genomic), 24 bp; single-stranded, linear
ggtggcgacgactcctggagcccg

SEQ ID NO: 11 - DNA (genomic), 8912 bp; single-stranded, linear
tgaattcgtgtgggttcggtggtggtggcgctttaggcagcctccacgcccaccacctcccagatagagcggcggcactgtagggaagaccggggaccggtcactaccaaggacgcagacctctttttgagtatcacgcctccggaagtagttgggcaagcccacctayatgtgttgggatggttggggttagccatccataccgtactgcctgatagggtccttgcgaggggatctgggagtctcgtagaccgtagcacatgcctgttatttctactcaaacaagtcctgtacctgcrcccagaacgcgcaagaacaagcagacgcaggcttcatatcctgtgtccattaaaacatctgttgaaaggggacaacgagcaargcgcaaagtccagcgcgatgctcggcctcgtaattacaaaattgctggtatccatgatggcttgcagacattggctcaggctgctttrccagctcatggttggggacgccaagaccctcgccataagtctcgcaatcttggaatccttctggattaccctttggggtggattggtgatgttacaactcacacacctctagtaggcccgctggtggcaggagcggtcgttcgaccagtctgccagatagtacgcttgctggaggatggagtcaactgggctactggttggttcggtgtccacctttttgtggtatgtctgctatytttggcctgtccctgtagtggggcgcgggtcactgacccagacacaaataccacaatcctgaccaattgctgccagcgtaatcaggttatctaytgttctccttccacttgcctacacgagcctggttgtgtgatctgtgyggacgagtgctgggttcccgccaatccrtacatctcacacccttccaattggactggcacggactccttcttggctgaccacattgattttgttatgggcgctcttgtgacctgtgacgcccttgacattggtgagttgtgtggtgcgtgtgtattagtcggtgactggcttgtcaggcactggcttattcacatagacctcaatgaaactggtacttgttacctggaaktgcctactggaatagatcctgggttcctagggtttatcgggtggatggccggcaaggtcgaggctgtcatcttcttgaccaaactggcttcacaagtaccatacgctattgcgactatgtttagcagtgtacactacctggcggttggcgctctgatctactaygcctctcggggcaagtggtatcagttgctcctagcgcttaygctttacatagaagcgacctctggaaacccyatcagggtgcccactggatgctcaatagctgagttttgctcgcctttgatgataccatgtccttgccactcttatttgagtgagaatgtgtcagaagtcatttgttacagtccaaagtggaccaggcctgtcactctagagtataabaactccatatcttggtacccctatacaatccctggtgcgaggggatgtatggttaaattcaaaaataacacatggggttgctgccgwwtcgcaatgtgccatcgtactgcactatgggcactgatgcagtgtggaassacagtcgcaacacttacgaagcatgcggtgtaacaccatggctaacaaccgcatggcacaacggctcagccctgaaattggctatattacaataccctgggtctaaagaaatgtttaaacctcataattggatgtcaggccacttgtattttgagggatcagatacccctatagtttacttttatgaccctgtgaattccactctcctaccaccggagaggtgggctaggttgcccggtaccccacctgtggtacgtggttcttggttacaggttccgcaaggttttacagtgatgtgaaagacctagccacaggattgatcaccaaagacaaagcctggaaaaattatcagytcttatattccgccacgggtgctttgtctcttacgggagttaccaccaaggccgtggtgctaattctgttggggttgtgtggcagcaagtatcttattttagcctacctctgttacttgtccctttgttttgggcgcgcttctggttacmctttgcgtcctgtgctcccatcccagtcgtatctccaagctggctgggatgttttgtctaaagctcaagtagctcmttttgctttgattttcttcatctgttgctatctccgctgcaggctacgttatgctgcccttttagggtttgtgcccatggctgcgggcttgcccctaactttctttgttgcagcagctgctgcccaaccagattatgactggtgggtgcgactgctagtggcagggttagttttgtgggccggccgtgaccgtggtcacgcatagctctgcttgtaggtccttggcctctggtagcgctttytaaccctcttgcatttsstkacgcctgcttagcttttgacaccgagataattggagggctgacaataccacctgtagtagcattagttgtcatgtctcgttttggcttctttgctcacttgttacctcgctgtgctttagttaactcctatctttggcaacgttgggagaattggttttggaacgttacactaagaccggagaggtttctccttgygctggtttgtttccccggtgcgacatatgacgtgctggtgacwttctgtgtgtgtcacgtagctcttctatgtttaacatccagtgcagcaymgttctttgggactgactctagggttagggcccatagaatgttggtgcgtctcggaaagtgtcatgcttggtattctcattatgttcttaagtttttcctcttagtgtttggtgagaatggtgtgtttttctakaagcacttgcatggtgatgtcttgcctaatgattttgcctcgaaactaccattgcaagagccatttttcccttttgaaggcaaggcaagggtctataggaatgaaggaagacgcttggskkgtggggacacggttgatggtttgsscgttgtbgcgcgtctcggcgaccttgttttcgcagggttagctatgccgccagatgggtgggccattaccgcaccttttacgctgcagtgtctctctgaacgtggcacgctgtcagcgatggcagtggtcatgactggtatagacccccgaacttggactggaactatcttcagattaggatctctggccactagctacatgggatttgtttgtgacaacgtgttgaatactgctcaccatggcagcaacgggggccggttggctcatcccacaggctccatacacccaataaccgttgacgcggctaatgaccaggacatctatcaaccaccatgtggagctgggtcccttactcggtgctcttgcggggagaccaaggggtatctggtaacacgactggggtcattggttgaggtcaacaaatccgatgacccttattggtgtgtgtgcggggcccttcccatggctgttgccaagggttcttcaggtgccccgattctgtgctcctccgggcatgttattgggatgttcaccgctgctagaaattctggcggttcagtcggccagattagggttaggccgttggtgtgtgctggataccatccccagtacacagcacatgccactcttgatacaaaacctactgtgcctaacgagtattcagtgcaaattttaattgcccccactggcagcggcaagtcaaccaaattaccactttcttacatgcaggrgaagyatgaggtcttggtcctaaatcccagtgtggctacaacagcatcaatgccaaagtacatgcacgcgacgtacggcgtgaatccaaattgctattttaatggcaaatgtaccaacacaggggcttcacttacgtacagcacatatggcatgtacctgaccggacgatgttcccggaactatgatgtaatcatttgtgacgaatgccatgctaccgatcgaaccaccgtgttgggcattggaaaggtcctaaccgaagctccatccaaaaatgttaggctagtggttcttgccacggctaccccccctggagtaatccctacaccacatgccaacataactgagattcaattaacygatgaaggcactatcccctttcatggaaaaaagattaaggaggaaaatctgaagaaagggagacaccttatctttgaggctaccaaaaaacactgtgatgagcttgctaacgagttagctcgaaagggaataacagctgtctcttactataggggatgtgacatctcaaaaatgcctgagggcgactgtgtagtagttgccactgatgccttgtgtacagggtacactggtgactttgattccgtgtatgactgcagcctcatggtagaaggcacatgccatgttgaccttgaccctactttcaccatgggtgttcgtgtgtgcggggtttcagcaatagttaaaggccagcgtaggggccgcacaggccgtgggagagctggcatatactactatgtagacgggagttgtaccccttcgggtatggttcctgaatgcaacattgttgaagccttcgacgcagccaaggcatggtatggtttgtcatcaacagaagctcaaactattctggacacctatcgcacccaacctgggttacctgcgataggagcaaatttggacgagtgggctgatctcttttctatggtcaaccccgaaccttcatttgtcaatactgcaaaaagaactgctgacaattatgttttgttgactgcagcccaactacaactgtgtcatcagtatggctatgctgctcccaatgacgcaccacggtggcagggagcccggcttgggaaaaaaccttgtggggttctgtggcgcttggacggctgtgacgcctgtcctggcccagagcccagcgaggtgaccagataccaaatgtgcttcactgaagtcaatacttctgggacagccgcactcgctgttggcgttggagtggctatggcttatctagccattgacacttttggcgccacttgtgtgcggcgttgctggtctattacatcagtccctaccggtgctactgtcgccccagtggttgacgaagaggaaatcgtggaggagtgtgcatcattcattcccttggaggccatggttgctgcaattgacaagctgaagagtacaatcaccacaactagtcctttcacattggaaaccgcccttgaaaaacttaacacctttcttgggcctcatgcagctacaatccttgctatcatagagtattgctgtggcttagtcactttacctgacaatccctttgcatcatgcgtgtttgctttcattgcgggtattactaccccactacctcacaagatcaaaatgttcctgtcattatttggaggcgcaattgcgtccaagcttacagacgctagagrcgcactggcgttcatgatggccggggctgygggaacagctcttggtacatggacatcggtgggttttgtctttgacatgctaggcggctatgctggcgcctcatccactgcttgcttgacatttaaatgcttgatgggtgagtggcycactatggatcagcttgctggtttagtctactccgcgttcaatccggccgcaggagttgtgggcgtcttgtcagcttgtgcaatgtttgctttgacaacagcagggccagatcactggcccaacagacttcttactatgcttgctaggagcaacactgtatgtartgagtactttattgccactcgtgacatccgcaggaagatactgggcattctggaggcatctaccccctggagtrtcatatcagcttgcatccgttggctycacaccccgacggaggatgattgcggcctcattgcttggggtctaragatttggcagtatgtgtgcaatttctttgtgatttgctttaatgtccttaaagctggagttcagagcatggttaacattcctggttgtcctttctacagctgccagaaggggtacaagggcccctggattggatcaggtatgctccaagcacgctgtccatgcggtgctgaactcatcttttctgttgagaatggttttgcaaaactttacaaaggacccagaacttgttcaaattactggagaggggctgttccagtcaacgctaggctgtgtgggtcggctagaccggacccaactgattggactagtcttgtcgtcaattatggcgttagggactactgtaaatatgagaaattgggagatcacatttttgttacagcagtatcctctccaaatgtctgtttcacccaggtgcccccaaccttgagagctgcagtggccgtggaccgcgtacaggttcagygttatctaggtgagcccaaaactccttggacgacatctgcttgctgttacggtcctgacggtaagggtaaaactgttaagcttcccttccgcgttgacggacacacacctggtggtcgcatgcaacttaatttgcgtgatcgacttgaggcaaatgactgtaattccataaacaacactcctagtgatgaagccgcagtgtccgctcttgttttcaaacaggagttgcggcgtacaaaccaattgcttgaggcaatttcagctggcgttgacaccaccaaactgccagccccctcccagatcgaagaggtagtggtaagaaagcgccagttccgggcaagaactggttcgcttaccttgcctccccctccgagatccgtcccaggagtgtcatgtcctgaaagcctgcaacgaagtgacccgttagaaggtccttcaamcctcccttcttcaccacctgttctrcagttggccatgccgatgcccctgttgggagcaggtgagtgtaaccctttcactgcaattggatgtgcaatgaccgaaacargyggagkcccwmakratttacccagttaccctcccaaaaaggaggtctctgaatggtcagacgaaagttggtcaacgactacaaccgcttccagctacgttactggccccccgtaccctaagatacggggcaaggattccactcaatcagccaccgccaaacggcctacaaaaaagaagttgggaaagagtgagttttcgtgcagcatgagctacacttggaccgacgtgattagcttcaaaactgcttctaaagttctgtctgcaactcgggccatcactagtggtttcctcaaacaaagatcattggtgtatgtgactgagccgcgggatgcggagcttagaaaacaaaaagtcactattaatagacaacctctgttccccccatcataccacaagcaagtgagattggctaaggaaaaagcttcaaaagttgtcggtgtcatgtgggactatgatgaagtagcagctcacacgccctctaagtctgctaagtcccacatcactggccttcggggcactgatgttcgttctggagcggcccgcaaggctgttctggacttgcagaagtgtgtcgaggcaggtgagataccgagtcattatcggcaaactgtgatagttccaaaggaggaggtcttcgtgaagaccccccagaaaccaacaaagaaacccccaaggcttatctcgtacccccaccttgaaatgagatgtgttgagaagatgtactacggtcaggttgctcctgacgtagttaaagctgtcatgggagatgcgtacgggtttgtagatccacgtacccgtgtcaagcgtctgttgtcgatgtggtcacccgatgcagtcggagccacatgcgatacagtgtgttttgacagtaccatcacacccgaggatatcatggtggagacagacatctactcagcagctaaactcagtgaccaacaccgagctggcattcacaccattgcgaggcagtatcacgctggaggaccgatgatcgcttatgatggccgagagatcggatatcgtaggtgtaggtcttccggcgtctatactacctcaagttccaacagtttgacctgctggctgaaggtaaatgctgcagccgaacaggctggcatgaagaaccctcgcttccttatttgcggcgatgattgcaccgtaatttggaagagcgccggagcagatgcagacaaacaagcaatgcgtgtctttgctagctggatgaaggtgatgggtgcaccacaagattgtgtgcctcaacccaaatacagtttggaagaattaacatcatgctcatcaaatgttacctctggaattaccaaaagtggcaagccttactactttcttacaagagatcctcgtatcccccttggcaggtgctctgccgagggtctgggatacaaccccagkgckgcgtggattgggtatctaatacatcactacccatgtttgtgggttagccgtgtgttggctgtccatttcatggagcagatgctctttgaggacaaacttcccgagactgtgacctttgactggtatgggaaaaattatacggtgcctgtagaagatctgcccagcatcattgctggtgtgcacggtattgaggctttctcggtggtgcgctacaccaacgctgagatcctcagagtttcccaatcactaacagacatgaccatgccccccctgcgagcctggcgaaagaaagccagggcggtcctcgccagcgccaagaggcgtggcggagcacacgaaaattggctcgcttccttctctggcatgctacatctagacctctaccagatttggataagacgagcgtggctcggtacaccactttcaattattgtgatgtttactcccsgagrgggatgtgtttattacaccacagagaagattgcagaagtttcttgtgaagtatttggctgtcattgtttgtgccctagggctcattgctgttggactagccatcagctgaacccccaaattcaaaattaattaacagtttttttttttttttttttttttttttagggc

SEQ ID NO: 12 - DNA (genomic), 197 bp; single-stranded, linear
gagtgtaaccctttcactgcaattggatgtgcaatgaccgaaacaggcggaggccctgatgatttacccagttaccctcccaaaaaggaggtctctgaatggtcagacgaaagttggtcaacgactacaaccgcttccagctacgttactggcccccgtaccctaagatacgggaaaggattccactcaattagccc

SEQ ID NO: 13 - DNA (genomic), 207 bp; single-stranded, linear
cctcgacacacttctgcaagtccagaacagccttgcgggctgctccagaacgaacatcagtgccccgaagccagtgatgtgggacttagcagacttagagggcgtgtgagctgctacttcatcatagtcccacatgacaccgacaacttttgaagctttttccttagccaatctcacttgcttgtggtatgatggggggaacagagg

SEQ ID NO: 14 - protein, 208 aa
ECNPFTAIGCAMTETXGXXXXLPSYPPKKEVSEWSDESWSTTTTASSYVTGPPYPKIRGKDSTQSATAKRPTKKKLGKSEFSCSMSYTWTDVISFKTASKVLSATRAITSGFLKQRSLVYVTEPRDAELRKQKVTINRQPLFPPSYHKQVRLAKEKASKVVGVMWDYDEVAAHTPSKSAKSHITGLRGTDVRSGAARKAVLDLQKCVE

SEQ ID NO: 15 - DNA (genomic), 230 bp; single-stranded, linear
ggttcctgaatgcaacattgttgaagccttcgacgcagccaaggcatggtatggtttgtcatcaacagaagctcaaactattctggacacctatcgcacccaacctgggttacctgcgataggagcaaatttggacgagtgggctgatctcttttctatggtcaaccccgaaccttcatttgtcaatactgcaaaaagaactgctgacaattatgttttgttgactgcag

SEQ ID NO: 16 - protein, 76 aa
VPECNIVEAFDAAKAWYGLSSTEAQTILDTYRTQPGLPAIGANLDEWADLFSMVNPEPSFVNTAKRTADNYVLLTA

SEQ ID NO: 17 - DNA (genomic), 291 bp; single-stranded, linear
gtatggttcctgaatgcaacattgttgaagccttcgacgcagccaaggcatggtatggtttgtcatcaacagaagctcaaactattctggacacctatcgcacccaacctgggttacctgcgataggagcaaatttggacgagtgggctgatctcttttctatggtcaaccccgaaccttcatttgtcaatactgcaaaaagaactgctgacaattatgttttgttgactgcagccctgccaccgtggtgcgtcattgggagcagcatagccatactgatgacacagttgt

SEQ ID NO: 18 - DNA (genomic), 281 bp; single-stranded, linear
gcgcatgcaacttaatttgcgtgatgcacttgagacaaatgactgtaattccataaacaacactcctagtgatgaagccgcagtgtccgctcttgttttcaaacaggagttgcggcgtacaaaccaattgcttgaggcaatttcagctggcgttgacaccaccaaactgccagccccctccatcgaagaggtagtggtaagaaagcgccagttccgggcaagaactggttcgcttaccttgcctccccctccgagatccgtcccaggagtgtcatgtcctg

SEQ ID NO: 19 - protein, 93 aa
RMQLNLRDALETNDCNSINNTPSDEAAVSALVFKQELRRTNQLLEAISAGVDTTKLPAPSIEEVVVRKRQFRARTGSLTLPPPPRSVPGVSCP

SEQ ID NO: 20 - DNA (genomic), 281 bp; single-stranded, linear; identical to SEQ ID NO: 18

SEQ ID NO: 21 - DNA (genomic), 221 bp; single-stranded, linear
gatccatagtgagccactcacccatcaagcatttaaatgtcaagcaagcagtggatgaggcggcagcatagccgcctagcatgtcaaagacaaaacccaccgatgtccatgtaccaagagctgttcccacagccccggccatcatgaacgccagtgcgtctctagcgtctgtaagcttggacgcaattgcgcctccaaataatgacaggaacattttgatc

SEQ ID NO: 22 - DNA (genomic), 737 bp; single-stranded, linear
gatcgaagcacacctcaagccctaagacgctgtgtcgctcccgggttaccccgcagctaccaccaataccagcggcagacgaccccttgcgaagtgcatcgccacaagcacggcagccctcacagagcccaggacattcaggtacgccacgacacacatcacacccagacaaccagtgaaccaccactcctgggctgcccagccgaccaccggggcgcacaccagctcgggagccagcgcgcctcgacgaccggcaagtaagccccaacatttgacaaccaggccagaccggcagcgaacgttcgcagcttgagccacgcgggccagatgtcaccaacgacggcctgagcaccatcattggcagcaccccagaccgcctgagccccggccgtcaggcctgccaccatgtagcaaccagcattgtaggtagagtccgcgactccggtggtagaattcggacaagatggagttggaacagtgggcggagtccacaatggaacactttcagtggacttcgtgacagaagggtgtatgataacaatagtggcggcagatgctccattcaaccaccaccacattgccagcataaacaggggggcaactctagcctcagccaacttcatcactaccaacagggccaggaccatgtcagtaagcaaccaagccgcggaagaccttcgctgaccactgtaaacctgctgtctgttgcctttaacatggatgaagccgttgtgatc

SEQ ID NO: 23 - DNA (genomic), 307 bp; single-stranded, linear
gatcactgtggacgccacttgtttcgactcatcgattgatgagcacgatatgcaggtggaggcctcggtgtttgcggcggctagtgacaacccctcaatggtacatgctttgtgcaagtactactctggtggccctatggtttccccagatggggttcccttggggtaccgccagtgtaggtcgtcgggcgtgttgacaactagctcggcgaacagcatcacttgttacattaaggtcagcgcggcctgcaggcgggtggggattaaggcaccatcattctttatagctggagatgattgcttgatc

SEQ ID NO: 24 - DNA (genomic), 500 bp; single-stranded, linear
gatcaggccgctgagcggccgagaaggttacaatctggaggggtgataggaagtatgacaagcattatgaggctgtcgttgaggctgtcctgaaaaaggcagccgcgacgaagtctcatggctggacctattcccaggctatagctaaagttaggcgccgagcagccgctggatacggcagcaaggtgaccgcctccacattggccactggttggcctcacgtggaggagatgctggacaaaatagccaggggacaggaagttcctttcacttttgtgaccaagcgagaggttttcttctccaaaactacccgtaagcccccaagattcatagttttcccacctttggacttcaggatagctgaaaagatgattctgggtgaccccggcatcgttgcaaagtcaattctgggtgacgcttatctgttccagtacacgcccaatcagagggtcaaagctctggttaaggcgtgggaggggaagttgcatcccgctgcgatc

SEQ ID NO: 25 - DNA (genomic), 479 bp; single-stranded, linear
gatcacatttttgttacagcagtatcctctccaaatgtctgtttcacccaggtgcccccaaccttgagagctgcagtggccgtggaccgcgtacaggttcagygttatctaggtgagcccaaaactccttggacgacatctgcttgctgttacggtcctgacggtaagggtaaaactgttaagcttcccttccgcgttgacggacacacacctggtggtcgcatgcaacttaatttgcgtgatcgacttgaggcaaatgactgtaattccataaacaacactcctagtgatgaagccgcagtgtccgctcttgttttcaaacaggagttgcggcgtacaaaccaattgcttgaggcaatttcagctggcgttgacaccaccaaactgccagccccctcccagatcgaagaggtagtggtaagaaagcgccagttccgggcaagaactggttcgcttaccttgcctccccctccgagatc

SEQ ID NO: 26 - DNA (genomic), 532 bp; single-stranded, linear
gatcaacacctcgtcaccccgtctcgcaaccacaggtttcccgtggaccaactgtccacagcctaacacacgagcagagtcccgaacaatagcacaatcttccttggttatgctaacaggctcaagcgcaaaaccccactctcgcaagcgggcagcaccgcgcctgctagtgtgaccggcgtgctcgtagaggaggacgccctgcttgcgcaggacgcccaccagccaagagcaggccagccgctcctcagcaagagctaaggagtccagcacccgcgccaagcgcgcgagatttggtgagttaaccaagagtacttccaagatgaaatcaatgacatctaaactgctcaaacagagtatgaagatgacggaaactgtggcaactgtttgggggaagaaccaagccacaaccaaccaagctttccagcacgcctccaacggccaaaagctccaaccggcgagttgttcacccaccggcgaaccctctggtaattgacggcccacctggcataccaagtcaatctggctgatc

SEQ ID NO: 27 - DNA (genomic), 306 bp; single-stranded, linear
gatccatcttgacaatgacaactttcgcaggacagtagacaccttggtgacgaactcatctttgaggaagaaatcgtcaggcatcaccgaactgcgtggcatcatcgtcaacaatctgttaacccaatcttgacccacaccctttttgacagaccagagcaacaagcccagaaccacaccggccaccgaagcccccggagaggccaggcaactgaccaggcaccaagcgtcactcgcttgtaacttccccgccaggaggtcgaaggtgagtgagcgcggttcaccgccccctcccagcctctgatc

SEQ ID NO: 28 - DNA (genomic), 369 bp; single-stranded, linear
gatcacccacaccccggttggttggcacttgcatgcctgaaggcaagaagcaccattagggagcgggtagaccgtgacgtcgtcactcgctaaccaccaccgagcattgacaggaccgaaagccccaccataggccggacgttggtaccacggtatgtcgtgtacatcactccgttcacgcagcagcccatggaacgagttgttgaagtcccaaggaccaccacgttcccgtgatgttcggacgagtccttgcctgtcatggaggtcctcacaaccccgaagaatcccttgccagcttgatgaagcaccacgggagcagtgggaacaaagccaggcggaaggtcgaaccgactgttcacacaactgatc

SEQ ID NO: 29 - DNA (genomic), 337 bp; single-stranded, linear
gatccaatccaggggccctcgtacccctcctggcagctgtagaaaggacaaccaggaatgttaaccatgctctgaactccagctttaaggacattaaagcaaatcacaaagaaattgcacacatactgccaaatctctagaccccaagcaatgaggccgcaatcatcctccgtcggggtgtggagccaacggatgcaagctgatatgatactccagggggtagatgcctccagaatgcccagtatcttctgcggatgtcacgagtggcaataaagtactcactacatacagtgttgctcctagcaagcatagtaagaagtctgttgggccagtgatc

SEQ ID NO: 30 - DNA (genomic), 234 bp; single-stranded, linear
gatcaggtatgctccaagcacgctgtccatgcggtgctgaactcatcttttctgttgagaatggttttgcaaaactttacaaaggacccagaacttgttcaaattactggagaggggctgttccagtcaacgctaggctgtgtgggtcggctagaccggacccaactgattggactagtcttgtcgtcaattatggcgttagggactactgtaaatatgagaaattgggagatc

SEQ ID NO: 31 - protein, 73 aa
DPXXATHPSSIXMSSKQWMRRQHSRLACQRQNPPMSMYQELFPQPRPSXTPVRLXRLXAWTQLRLQIMTGTFX

SEQ ID NO: 32 - protein, 73 aa
IHSEPLTHQAFKCQASSGXGGSIAAXHVKDKTHRCPCTKSCSHSPGHHERQCVSSVCKLGRNCASKXXQEHFD

SEQ ID NO: 33 - protein, 73 aa
SIVSHSPIKHLNVKQAVDEAAAXPPSMSKTKPTDVHVPRAVPTAPAIMNASASLASVSLDAIAPPNNDRNILI

SEQ ID NO: 34 - protein, 73 aa
DQNVPVIIWRRNCVQAYRRXRRTGVHDGRGCGNSSWYMDIGGFCLXHARRLCCRLIHCLLDIXMLDGXVAHYG

SEQ ID NO: 35 - protein, 73 aa
IKMFLSLFGGAIASKLTDARDALAFMMAGAVGTALGTWTSVGFVFDMLGGYAAASSTACLTFKCLMGEWLTMD

SEQ ID NO: 36 - protein, 73 aa
SKCSCHYLEAQLRPSLQTLETHWRSXWPGLWEQLLVHGHRWVLSLTCXAAMLPPHPLLAXHLNAXWVSGSLWI

SEQ ID NO: 37 - protein, 245 aa
DRSTPQALRRCVAPGLPRSYHQYQRQTTPCEVHRHKHGSPHRAQDIQVRHDTHHTQTTSEPPLLGCPADHRGAHQLGSQRASTTGKXAPTFDNQARPAANVRSLSHAGQMSPTTAXAPSLAAPQTAXAPAVRPATMXQPALXVESATPVVEFGQDGVGTVGGVHNGTLSVDFVTEGCMITIVAADAPFNHHHIASINRGATLASANFITTNRARTMSVSNQAAEDLRXPLXTCCLLPLTWMKPLX

SEQ ID NO: 38 - protein, 245 aa
IEAHLKPXDAVSLPGYPAATTNTSGRRPLAKCIATSTAALTEPRTFRYATTHITPRQPVNHHSWAAQPTTGAHTSSGASAPRRPASKPQHLTTRPDRQRTFAAXATRARCHQRRPEHHHWQHPRPPEPRPSGLPPCSNQHCRXSPRLRWXNSDKMELEQWAESTMEHFQWTSXQKGVXXQXWRQMLHSTTTTLPAXTGGQLXPQPTSSLPTGPGPCQXATKPRKTFADHCKPAVCCLXHGXSRCD

SEQ ID NO: 39 - protein, 245 aa
SKHTSSPKTLCRSRVTPQLPPIPAADDPLRSASPQARQPSQSPGHSGTPRHTSHPDNQXTTTPGLPSRPPGRTPAREPARLDDRQVSPNIXQPGQTGSERSQLEPRGPDVTNDGLSTIIGSTPDRLSPGRQACHHVATSIVGRVRDSGGRIRTRWSWNSGRSPQWNTFSGLRDRRVYDNNSGGRCSIQPPPHCQHKQGGNSSLSQLHHYQQGQDHVSKQPSRGRPSLTTVNLLSVAFNMDEAVVI

SEQ ID NO: 40 - protein, 245 aa
DHNGFIHVKGNRQQVYSGQRRSSAAWLLTDMVLALLVVMKLAEARVAPLFMLAMWWWLNGASAATIVIIHPSVTKSTESVPLWTPPTVPTPSCPNSTTGVADSTYNAGCYMVAGLTAGAQAVWGAANDGAQAVVGDIWPAWLKLRTFAAGLAWLSNVGAYLPVVEARWLPSWCAPRWSAGQPRSGGSLVVWVXCVSWRTXMSWALXGLPCLWRCTSQGVVCRWYWWXLRGNPGATQRLRAXGVLR

SEQ ID NO: 41 - protein, 245 aa
ITTASSMLKATDSRFTVVSEGLPRLGCLLTWSWPCWXXXSWLRLELPPCLCWQCGGGXMEHLPPLLLSYTLLSRSPLKVFHCGLRPLFQLHLVRILPPESRTLPTMLVATWWQAXRPGLRRSGVLPMMVLRPSLVTSGPRGSSCERSLPVWPGCQMLGLTCRSSRRAGSRAGVRPGGRLGSPGVVVHWLSGCDVCRGVPECPGLCEGCRACGDALRKGSSAAGIGGSCGVTRERHSVLGLEVCFD

SEQ ID NO: 42 - protein, 245 aa
SQRLHPCXRQQTAGLQWSAKVFRGLVAYXHGPGPVGSDEVGXGXSCPPVYAGNVVVVEWSICRHYCYHTPFCHEVHXKCSIVDSAHCSNSILSEFYHRSRGLYLQCWLLHGGRPDGRGSGGLGCCQXWCSGRRWXHLARVAQAANVRCRSGLVVKCWGLLAGRRGALAPELVCAPVVGWAAQEWWFTGCLGVMCVVAYLNVLGSVRAAVLVAMHFARGRLPLVLVVAAGXPGSDTASXGLRCASI

SEQ ID NO: 43 - protein, 102 aa
DHCGRHLFRLIDXXARYAGGGLGVCGGXXQPLNGTCFVQVLLWWPYGFPRWGSLGVPPVXVVGRVDNXLGEQHHLLHXGQRGLQAGGDXGTIILYSWRXLLD

SEQ ID NO: 44 - protein, 102 aa
ITVDATCFDSSIDEHDMQVEASVFAAASDNPSMVHALCKYYSGGPMVSPDGVPLGYRQCRSSGVLTTSSANSITCYIKVSAACRRVGIKAPSFFIAGDDCLI

SEQ ID NO: 45 - protein, 101 aa
SLWTPLVSTHRLMSTICRWRPRCLRRLVTTPQWYMLCASTTLVALWFPQMGFPWGTASVGRRACXQLARRTASLVTLRSARPAGGWGLRHHHSLXLEMIAX

SEQ ID NO: 46 - protein, 102 aa
DQAIISSYKEXWCLNPHPPAGRADLNVTSDAVRRASCQHARRPTLAVPQGNPIWGNHRATRVVLAQSMYHXGVVTSRRKHRGLHLHIVLINRXVETSGVHSD

SEQ ID NO: 47 - protein, 102 aa
IKQSSPAIKNDGALIPTRLQAALTLMXQVMLFAELVVNTPDDLHWRYPKGTPSGETIGPPEXYLHKACTIEGLSLAAANTEASTCISCSSIDESKQVASTVI

SEQ ID NO: 48 - protein, 101 aa
SSNHLQLXRMMVPXSPPACRPRXPXCNKXCCSPSXLSTRPTTYTGGTPREPHLGKPXGHQSSTCTKHVPLRGCHXPPQTPRPPPAYRAHQSMSRNKWRPQX

SEQ ID NO: 49 - protein, 177 aa
DQHLVTPSRNHRFPVDQLSTAXHTSRVPNNSTIFLGYANRLKRKTPLSQAGSTAPASVTGVLVEEDALLAQDAHQPRAGQPLLSKSXGVQHPRQAREIWXVNQEYFQDEINDIXTAQTEYEDDGNCGNCLGEEPSHNQPSFPARLQRPKAPTGELFTHRRTLWXLTAHLAYQVNLAD

SEQ ID NO: 50 - protein, 177 aa
INTSSPRLATTGFPWTNCPQPNTRAESRTIAQSSLVMLTGSSAKPHSRKRAAPRLLVXPACSXRRTPCLRRTPTSQEQASRSSARAKESSTRAKRARFGELTKSTSKMKSMTSKLLKQSMKMTETVATVWGKNQATTNQAFQHASNGQKLQPASCSPTGEPSGNXRPTWHTKSIWLI

SEQ ID NO: 51 - protein, 176 aa
STPRHPVSQPQVSRGPTVHSLTHEQSPEQXHNLPWLCXQAQAQNPTLASGQHRACXCDRRARRGGRPACAGRPPAKSRPAAPQQELRSPAPAPSARDLVSXPRVLPRXNQXHLNCSNRVXRXRKLWQLFGGRTKPQPTKLSSTPPTAKSSNRRVVHPPANPLVIDGPPGIPSQSGX

SEQ ID NO: 52 - protein, 177 aa
DQPDXLGMPGGPSITRGFAGGXTTRRLELLAVGGVLESLVGCGLVLPPNSCHSFRHLHTLFEQFRCHXFHLGSTLGXLTKSRALGAGAGLLSSCXGAAGLLLAGGRPAQAGRPPLRARRSHXQARCCPLARVGFCAXACXHNQGRLCYCSGLCSCVRLWTVGPRETCGCETGXRGVD

SEQ ID NO: 53 - protein, 177 aa
ISQIDLVCQVGRQLPEGSPVGEQLAGWSFWPLEACWKAWLVVAWFFPQTVATVSVIFILCLSSLDVIDFILEVLLVNSPNLARLARVLDSLALAEERLACSWLVGVLRKQGVLLYEHAGHTSRRGAARLREWGFALEPVSITKEDCAIVRDSARVLGCGQLVHGKPVVARRGDEVLI

SEQ ID NO: 54 - protein, 176 aa
SARLTWYARWAVNYQRVRRWVNNSPVGAFGRWRRAGKLGWLWLGSSPKQLPQFPSSSYSVXAVXMSLISSWKYSWLTHQISRAWRGCWTPXLLLRSGWPALGWWASCASRASSSTSTPVTLAGAVLPACESGVLRLSLLAXPRKIVLLFGTLLVCXAVDSWSTGNLWLRDGVTRCX

SEQ ID NO: 55 - protein, 102 aa
DPSXQXQLSQDSRHLGDELIFEEEIVRHHRTAWHHRQQSVNPILTHTLFDRPEQQAQNHTGHRSPRRGQATDQAPSVTRLXLPRQEVEGEXARFTAPSQPLI

SEQ ID NO: 56 - protein, 101 aa
IHLDNDNFRRTVDTLVTNSSLRKKSSGITELRGIIVNNLLTQSXPTPFLTDQSNKPRTTPATEAPGEARQLTRHQASLACNFPARRSKVSERGSPPPPSLX

SEQ ID NO: 57 - protein, 101 aa
SILTMTTFAGQXTPWXRTHLXGRNRQASPNCVASSSTICXPNLDPHPFXQTRATSPEPHRPPKPPERPGNXPGTKRHSLVTSPPGGRRXVSAVHRPLPASD

SEQ ID NO: 58 - protein, 102 aa
DQRLGGGGEPRSLTFDLLAGKLQASDAWCLVSCLASPGASVAGVVLGLLLWSVKKGVGQDWVNRLLTMMPRSSVMPDDFFLKDEFVTKVSTVLRKLSLSRWI

SEQ ID NO: 59 - protein, 101 aa
IRGWEGAVNRAHSPSTSWRGSYKRVTLGAWSVAWPLRGLRWPVWFWACCSGLSKRVWVKIGLTDCXRXCHAVRXCLTISSSKMSSSPRCLLSCESCHCQDG

SEQ ID NO: 60 - protein, 101 aa
SEAGRGRXTALTHLRPPGGEVTSEXRLVPGQLPGLSGGFGGRCGSGLVALVCQKGCGSRLGXQIVDDDATQFGDAXRFLPQRXVRHQGVYCPAKVVIVKMD

SEQ ID NO: 61 - protein, 123 aa
DHPHPGWLALACLKARSTIRERVDRDVVTRXPPPSIDRTESPTIGRTLVPRYVVYITPFTQQPMERVVEVPRTTTFPXCSDESLPVMEVLTTPKNPLPAXXSTTGAVGTKPGGRSNRLFTQLI

SEQ ID NO: 62 - protein, 122 aa
ITHTPVGWHLHAXRQEAPLGSGXTVTSSLANHHRALTGPKAPPXAGRWYHGMSCTSLRSRSSPWNELLKSQGPPRSRDVRTSPCLSWRSSQPRRIPCQLDEAPREQWEQSQAEGRTDCSHNX

SEQ ID NO: 63 - protein, 122 aa
SPTPRLVGTCMPEGKKHHXGAGRPXRRHSLTTTEHXQDRKPHHRPDVGTTVCRVHHSVHAAAHGTSCXSPKDHHVPVMFGRVLACHGGPHNPEESLASLMKHHGSSGNKARRKVEPTVHTTD

SEQ ID NO: 64 - protein, 123 aa
DQLCEQSVRPSAWLCSHCSRGASSSWQGILRGCEDLHDRQGLVRTSRERGGPWDFNNSFHGLLRERSDVHDIPWYQRPAYGGAFGPVNARWWLASDDVTVYPLPNGASCLQACKCQPTGVWVI

SEQ ID NO: 65 - protein, 122 aa
ISCVNSRFDLPPGFVPTAPVVLHQAGKGFFGVVRTSMTGKDSSEHHGNVVVLGTSTTRSMGCCVNGVMYTTYRGTNVRPMVGLSVLSMLGGGXRVTTSRSTRSLMVLLAFRHASANQPGCGX

SEQ ID NO: 66 - protein, 122 aa
SVVXTVGSTFRLALFPLLPWCFIKLARDSSGLXGPPXQARTRPNITGTWWSLGLQQLVPWAAAXTEXCTRHTVVPTSGLWWGFRSCQCSVVVSEXRRHGLPAPXWCFLPSGMQVPTNRGVGD

SEQ ID NO: 67 - protein, 112 aa
DPIQGPSYPSWQLXKGQPGMLTMLXTPALRTLKQITKKLHTYCQISRPQAMRPQSSSVGVWSQRMQADMILQGVDASRMPSIFCGCHEWQXSTHYIQCCSXQAXXEVCWASD

SEQ ID NO: 68 - protein, 112 aa
IQSRGPRTPPGSCRKDNQECXPCSELQLXGHXSKSQRNCTHTAKSLDPKQXGRNHPPSGCGANGCKLIXYSRGXMPPECPVSSADVTSGNKVLTTYSVAPSKHSKKSVGPVI

SEQ ID NO: 69 - protein, 111 aa
SNPGALVPLLAAVERTTRNVNHALNSSFKDIKANHKEIAHILPNLXTPSNEAAIILRRGVEPTDASXYDTPGGRCLQNAQYLLRMSRVAIKYSLHTVLLLASIVRSLLGQX

SEQ ID NO: 70 - protein, 112 aa
DHWPNRLLTMLARSNTVCSEYFIATRDIRRRYWAFWRHLPPGVSYQLASVGSTPRRRMIAASLLGVXRFGSMCAISLXFALMSLKLEFRAWLTFLVVLSTAARRGTRAPGLD

SEQ ID NO: 71 - protein, 112 aa
ITGPTDFLLCLLGATLYVVSTLLPLVTSAEDTGHSGGIYPLEYHISLHPLAPHPDGGXLRPHCLGSRDLAVCVQFLCDLLXCPXSWSSEHGXHSWLSFLQLPGGVRGPLDWI

SEQ ID NO: 72 - protein, 111 aa
SLAQQTSYYACXEQHCMXXVLYCHSXHPQKILGILEASTPWSIISACIRWLHTPTEDDCGLIAWGLEIWQYVCNFFVICFNVLKAGVQSMVNIPGCPFYSCQEGYEGPWIG

SEQ ID NO: 73 - DNA (genomic), 795 bp; single-stranded, linear
gatcaggccgctgagcggccgagaaggttacaatctggaggggtgataggaagtatgacaagcattatgaggctgtcgttgaggctgtcctgaaaaaggcagccgcgacgaagtctcatggctggacctattcccaggctatagctaaagttaggcgccgagcagccgctggatacggcagcaaggtgaccgcctccacattggccactggttggcctcacgtggaggagatgctggacaaaatagccaggggacaggaagttcctttcacttttgtgaccaagcgagaggttttcttctccaaaactacccgtaagcccccaagattcatagttttcccacctttggacttcaggatagctgaaaagatgattctgggtgaccccggcatcgttgcaaagtcaattctgggtgacgcttatctgttccagtacacgcccaatcagagggtcaaagctctggttaaggcgtgggaggggaagttgcatcccgctgcgatcaccgtgkacgccacttgtttcgactcatcgattgatgagcacgacatgcaggtggaggcttcggtgtttgcggcggctagtgacaacccctcaatggtacatgctttgtgcaagtactactctggtggccctatggtttccccagatggggttcccttggggtaccgccagtgtaggtcgtcgggcgtgttgacaactagctcggcgaacagcatcacttgttacattaaggtcagcgcggcctgcaggcgggtggggattaaggcaccatcattctttatagctggagatgatt

SEQ ID NO: 74 - protein, 265 aa
DQAAERPRRLQSGGVIGSMTSIMRLSLRLSXKRQPRRSLMAGPIPRLXLKLGAEQPLDTAARXPPPHWPLVGLTWRRCWTKXPGDRKFLSLLXPSERFSSPKLPVSPQDSXFSHLWTSGXLKRXFWVTPASLQSQFWVTLICSSTRPIRGSKLWLRRGRGSCIPLRSPXTPLVSTHRLMSTTCRWRLRCLRRLVTTPQWYMLCASTTLVALWFPQMGFPWGTASVGRRACXQLARRTASLVTLRSARPAGGWGLRHHHSLXLEMI

SEQ ID NO: 75 - protein, 264 aa
IRPLSGREGYNLEGXXEVXQALXGCRXGCPEKGSRDEVSWLDLFPGYSXSXAPSSRWIRQQGDRLHIGHWLASRGGDAGQNSQGTGSSFHFCDQARGFLLQNYPXAPKIHSFPTFGLQDSXKDDSGXPRHRCKVNSGXRLSVPVHAQSEGQSSGXGVGGEVASRCDHRXRHLFRLIDXXARHAGGGFGVCGGXXQPLNGTCFVQVLLWWPYGFPRWGSLGVPPVXVVGRVDNXLGEQHHLLHXGQRGLQAGGDXGTIILYSWRX

SEQ ID NO: 76 - protein, 264 aa
SGRXAAEKVTIWRGDRKYDKHYEAVVEAVLKKAAATKSHGWTYSQAIAKVRRRAAAGYGSKVTASTLATGWPHVEEMLDKIARGQEVPFTFVTKREVFFSKTTRKPPRFIVFPPLDFRIAEKMILGDPGIVAKSILGDAYLFQYTPNQRVKALVKAWEGKLHPAAITVXATCFDSSIDEHDMQVEASVFAAASDNPSMVHALCKYYSGGPMVSPDGVPLGYRQCRSSGVLTTSSANSITCYIKVSAACRRVGIKAPSFFIAGDD

SEQ ID NO: 77 - protein, 265 aa
NHLQLXRMMVPXSPPACRPRXPXCNKXCCSPSXLSTRPTTYTGGTPREPHLGKPXGHQSSTCTKHVPLRGCHXPPQTPKPPPACRAHQSMSRNKWRXRXSQRDATSPPTPXPELXPSDWACTGTDKRHPELTLQRCRGHPESSFQLSXSPKVGKLXILGAYGXFWRRKPLAWSQKXKELPVPWLFCPASPPREANQWPMWRRSPCCRIQRLLGAXLXLXPGNRSSHETSSRLPFSGQPQRQPHNACHTSYHPSRLXPSRPLSGLI

SEQ ID NO: 78 - protein, 264 aa
IISSYKEXWCLNPHPPAGRADLNVTSDAVRRASCQHARRPTLAVPQGNPIWGNHRATRVVLAQSMYHXGVVTSRRKHRSLHLHVVLINRXVETSGVHGDRSGMQLPLPRLNQSFDPLIGRVLEQISVTQNXLCNDAGVTQNHLFSYPEVQRWENYESWGLTGSFGEENLSLGHKSERNFLSPGYFVQHLLHVRPTSGQCGGGHLAAVSSGCSAPNFSYSLGIGPAMRLRRGCLFQDSLNDSLIMLVILPITPPDCNLLGRSAAX

SEQ ID NO: 79 - protein, 264 aa
SSPAIKNDGALIPTRLQAALTLMXQVMLFAELVVNTPDDLHWRYPKGTPSGETIGPPEXYLHKACTIEGLSLAAANTEASTCMSCSSIDESKQVAXTVIAAGCNFPSHALTRALTLXLGVYWNRXASPRIDFATMPGSPRIIFSAILKSKGGKTMNLGGLRVVLEKKTSRLVTKVKGTSCPLAILSSISSTXGQPVANVEAVTLLPYPAAARRLTLAIAWEXVQPXDFVAAAFFRTASTTASXCLSYFLSPLQIVTFSAAQRPD

SEQ ID NO: 80 - DNA (genomic), 4268 bp; single-stranded, linear
tggctcatcccacaggctccatacacccaataaccgttgacgcggctaatgaccaggacatctatcaaccaccatgtggagctgggtcccttactcggtgctcttgcggggagaccaaggggtatctggtaacacgactggggtcattggttgaggtcaacaaatccgatgacccttattggtgtgtgtgcggggcccttcccatggctgttgccaagggttcttcaggtgccccgattctgtgctcctccgggcatgttattgggatgttcaccgctgctagaaattctggcggttcagtcggccagattagggttaggccgttggtgtgtgctggataccatccccagtacacagcacatgccactcttgatacaaaacctactgtgcctaacgagtattcagtgcaaattttaattgcccccactggcagcggcaagtcaaccaaattaccactttcttacatgcaggrgaagyatgaggtcttggtcctaaatcccagtgtggctacaacagcatcaatgccaaagtacatgcacgcgacgtacggcgtgaatccaaattgctattttaatggcaaatgtaccaacacaggggcttcacttacgtacagcacatatggcatgtacctgaccggacgatgttcccggaactatgatgtaatcatttgtgacgaatgccatgctaccgatcgaaccaccgtgttgggcattggaaaggtcctaaccgaagctccatccaaaaatgttaggctagtggttcttgccacggctaccccccctggagtaatccctacaccacatgccaacataactgagattcaattaacygatgaaggcactatcccctttcatggaaaaaagattaaggaggaaaatctgaagaaagggagacaccttatctttgaggctaccaaaaaacactgtgatgagcttgctaacgagttagctcgaaagggaataacagctgtctcttactataggggatgtgacatctcaaaaatgcctgagggcgactgtgtagtagttgccactgatgccttgtgtacagggtacactggtgactttgattccgtgtatgactgcagcctcatggtagaaggcacatgccatgttgaccttgaccctactttcaccatgggtgttcgtgtgtgcggggtttcagcaatagttaaaggccagcgtaggggccgcacaggccgtgggagagctggcatatactactatgtagacgggagttgtaccccttcgggtatggttcctgaatgcaacattgttgaagccttcgacgcagccaaggcatggtatggtttgtcatcaacagaagctcaaactattctggacacctatcgcacccaacctgggttacctgcgataggagcaaatttggacgagtgggctgatctcttttctatggtcaaccccgaaccttcatttgtcaatactgcaaaaagaactgctgacaattatgttttgttgactgcagcccaactacaactgtgtcatcagtatggctatgctgctcccaatgacgcaccacggtggcagggagcccggcttgggaaaaaaccttgtggggttctgtggcgcttggacggctgtgacgcctgtcctggcccagagcccagcgaggtgaccagataccaaatgtgcttcactgaagtcaatacttctgggacagccgcactcgctgttggcgttggagtggctatggcttatctagccattgacacttttggcgccacttgtgtgcggcgttgctggtctattacatcagtccctaccggtgctactgtcgccccagtggttgacgaagaggaaatcgtggaggagtgtgcatcattcattcccttggaggccatggttgctgcaattgacaagctgaagagtacaatcaccacaactagtcctttcacattggaaaccgcccttgaaaaacttaacacctttcttgggcctcatgcagctacaatccttgctatcatagagtattgctgtggcttagtcactttacctgacaatccctttgcatcatgcgtgtttgctttcattgcgggtattactaccccactacctcacaagatcaaaatgttcctgtcattatttggaggcgcaattgcgtccaagcttacagacgctagagrcgcactggcgttcatgatggccggggctgygggaacagctcttggtacatggacatcggtgggttttgtctttgacatgctaggcggctatgctggcgcctcatccactgcttgcttgacatttaaatgcttgatgggtgagtggcycactatggatcagcttgctggtttagtctactccgcgttcaatccggccgcaggagttgtgggcgtcttgtcagcttgtgcaatgtttgctttgacaacagcagggccagatcactggcccaacagacttcttactatgcttgctaggagcaacactgtatgtartgagtactttattgccactcgtgacatccgcaggaagatactgggcattctggaggcatctaccccctggagtrtcatatcagcttgcatccgttggctycacaccccgacggaggatgattgcggcctcattgcttggggtctaragatttggcagtatgtgtgcaatttctttgtgatttgctttaatgtccttaaagctggagttcagagcatggttaacattcctggttgtcctttctacagctgccagaaggggtacaagggcccctggattggatcaggtatgctccaagcacgctgtccatgcggtgctgaactcatcttttctgttgagaatggttttgcaaaactttacaaaggacccagaacttgttcaaattactggagaggggctgttccagtcaacgctaggctgtgtgggtcggctagaccggacccaactgattggactagtcttgtcgtcaattatggcgttagggactactgtaaatatgagaaattgggagatcacatttttgttacagcagtatcctctccaaatgtctgtttcacccaggtgcccccaaccttgagagctgcagtggccgtggaccgcgtacaggttcagygttatctaggtgagcccaaaactccttggacgacatctgcttgctgttacggtcctgacggtaagggtaaaactgttaagcttcccttccgcgttgacggacacacacctggtggtcgcatgcaacttaatttgcgtgatcgacttgaggcaaatgactgtaattccataaacaacactcctagtgatgaagccgcagtgtccgctcttgttttcaaacaggagttgcggcgtacaaaccaattgcttgaggcaatttcagctggcgttgacaccaccaaactgccagccccctcccagatcgaagaggtagtggtaagaaagcgccagttccgggcaagaactggttcgcttaccttgcctccccctccgagatccgtcccaggagtgtcatgtcctgaaagcctgcaacgaagtgacccgttagaaggtccttcaamcctcccttcttcaccacctgttctrcagttggccatgccgatgcccctgttgggagcaggtgagtgtaaccctttcactgcaattggatgtgcaatgaccgaaacargyggagkcccwsakratttacccagttaccctcccaaaaaggaggtctctgaatggtcagacgaaagttggtcaacgactacaaccgcttccagctacgttactggccccccgtaccctaagatacggggcaaggattccactcaatcagccaccgccaaacggcctacaaaaaagaagttgggaaagagtgagttttcgtgcagcatgagctacacttggaccgacgtgattagcttcaaaactgcttctaaagttctgtctgcaactcgggccatcactagtggtttcctcaaacaaagatcattggtgtatgtgactgagccgcgggatgcggagcttagaaaacaaaaagtcactattaatagacaacctctgttccccccatcataccacaagcaagtgagattggctaaggaaaaagcttcaaaagttgtcggtgtcatgtgggactatgatgaagtagcagctcacacgccctctaagtctgctaagtcccacatcactggccttcggggcactgatgttctggacttgcagaagtgtgtcgaggcaggtgagataccgagtcattatcggcaaactgtgatagttccaaaggaggaggtcttcgtgaagaccccccagaaaccaacaaagaaacccccaaggcttatc

SEQ ID NO: 81 - protein, 1422 aa
WLIPQAPYTQXPLTRLMTRTSINHHVELGPLLGALAGRPRGIWXHDWGHWLRSTNPMTLIGVCAGPFPWLLPRVLQVPRFCAPPGMLLGCSPLLEILAVQSARLGLGRWCVLDTIPSTQHMPLLIQNLLCLTSIQCKFXLPPLAAASQPNYHFLTCRXSMRSWSXIPVWLQQHQCQSTCTRRTAXIQIAILMANVPTQGLHLRTAHMACTXPDDVPGTMMXSFVTNAMLPIEPPCWALERSXPKLHPKMLGXWFLPRLPPLEXSLHHMPTXLRFNXXMKALSPFMEKRLRRKIXRKGDTLSLRLPKNTVMSLLTSXLEREXQLSLTIGDVTSQKCLRATVXXLPLMPCVQGTLVTLIPCMTAASWXKAHAMLTLTLLSPWVFVCAGFQQXLKASVGAAQAVGELAYTTMXTGVVPLRVWFLNATLLKPSTQPRHGMVCHQQKLKLFWTPIAPNLGYLRXEQIWTSGLISFLWSTPNLHLSILQKELLTIMFCXLQPNYNCVISMAMLLPMTHHGGREPGLGKNLVGFCGAWTAVTPVLAQSPARXPDTKCASLKSILLGQPHSLLALEWLWLIXPLTLLAPLVCGVAGLLHQSLPVLLSPQWLTKRKSWRSVHHSFPWRPWLLQLTSXRVQSPQLVLSHWKPPLKNLTPFLGLMQLQSLLSXSIAVAXSLYLTIPLHHACLLSLRVLLPHYLTRSKCSCHYLEAQLRPSLQTLEXHWRSXWPGLXEQLLVHGHRWVLSLTCXAAMLAPHPLLAXHLNAXWVSGXLWISLLVXSTPRSIRPQELWASCQLVQCLLXQQQGQITGPTDFLLCLLGATLYVXSTLLPLVTSAGRYWAFWRHLPPGVSYQLASVGXTPRRRMIAASLLGVXRFGSMCAISLXFALMSLKLEFRAWLTFLVVLSTAARRGTRAPGLDQVCSKHAVHAVLNSSFLLRMVLQNFTKDPELVQITGEGLFQSTLGCVGRLDRTQLIGLVLSSIMALGTTVNMRNWEITFLLQQYPLQMSVSPRCPQPXELQWPWTAYRFSVIXVSPKLLGRHLLAVTVLTVRVKLLSFPSALTDTHLVVACNLICVIDLRQMTVIPXTTLLVMKPQCPLLFSNRSCGVQTNCLRQFQLALTPPNCQPPPRSKRXWXESASSGQELVRLPCLPLRDPSQECHVLKACNEVTRXKVLQXSLLHHLFXSWPCRCPCWEQVSVTLSLQLDVQXPKQXEXXXIYPVTLPKRRSLNGQTKVGQRLQPLPATLLAPRTLRYGARIPLNQPPPNGLQKRSWERVSFRAAXATLGPTXLASKLLLKFCLQLGPSLVVSSNKDHWCMXLSRGMRSLENKKSLLIDNLCSPHHTTSKXDWLRKKLQKLSVSCGTMMKXQLTRPLSLLSPTSLAFGALMFWTCRSVSRQVRYRVIIGKLXXFQRRRSSXRPPRNQQRNPQGL

SEQ ID NO: 82 - protein, 1422 aa
GSSHRLHTPNNRXRGXXPGHLSTTMWSWVPYSVLLRGDQGVSGNTTGVIGXGQQIRXPLLVCVRGPSHGCCQGFFRCPDSVLLRACYWDVHRCXKFWRFSRPDXGXAVGVCWIPSPVHSTCHSXYKTYCAXRVFSANFNCPHWQRQVNQITTFLHAGEXXGLGPKSQCGYNSINAKVHARDVRRESKLLFXWQMYQHRGFTYVQHIWHVPDRTMFPELXCNHLXRMPCYRSNHRVGHWKGPNRSSIQKCXASGSCHGYPPWSNPYTTCQHNXDSINXXRHYPLSWKKDXGGKSEERETPYLXGYQKTLXXACXRVSSKGNNSCLLLXGMXHLKNAXGRLCSSCHXCLVYRVHWXLXFRVXLQPHGRRHMPCXPXPYFHHGCSCVRGFSNSXRPAXGPHRPWESWHILLCRRELYPFGYGSXMQHCXSLRRSQGMVWFVINRSSNYSGHLSHPTWVTCDRSKFGRVGXSLFYGQPRTFICQYCKKNCXQLCFVDCSPTTTVSSVWLCCSQXRTTVAGSPAWEKTLWGSVALGRLXRLSWPRAQRGDQIPNVLHXSQYFWDSRTRCWRWSGYGLSSHXHFWRHLCAALLVYYISPYRCYCRPSGXRRGNRGGVCIIHSLGGHGCCNXQAEEYNHHNXSFHIGNRPXKTXHLSWASCSYNPCYHRVLLWLSHFTXQSLCIMRVCFHCGYYYPTTSQDQNVPVIIWRRNCVQAYRRXRRTGVHDGRGCGNSSWYMDIGGFCLXHARRLCWRLIHCLLDIXMLDGXVAHYGSACWFSLLRVQSGRRSCGRLVSLCNVCFDNSRARSLAQQTSYYACXEQHCMXXVLYCHSXHPQEDTGHSGGIYPLEXHISLHPLAXHPDGGXLRPHCLGSXDLAVCVQFLCDLLXCPXSWSSEHGXHSWLSFLQLPEGVQGPLDWIRYAPSTLSMRCXTHLFCXEWFCKTLQRTQNLFKLLERGCSSQRXAVWVGXTGPNXLDXSCRQLWRXGLLXIXEIGRSHFCYSSILSKCLFHPGAPNLESCSGRGPRTGSXLSRXAQNSLDDICLLLRSXRXGXNCXASLPRXRTHTWWSHATXFAXSTXGKXLXFHKQHSXXXSRSVRSCFQTGVAAYKPIAXGNFSWRXHHQTASPLPDRRGSGKKAPVPGKNWFAYLASPSEIRPRSVMSXKPATKXPVRRSFXPPFFTTCSXVGHADAPVGSRXVXPFHCNWMCNDRNXXXPXXFTQLPSQKGGLXMVRRKLVNDYNRFQLRYWPPVPXDTGQGFHSISHRQTAYKKEVGKEXVFVQHELHLDRRDXLQNCFXSSVCNSGHHXWFPQTKIIGVCDXAAGCGAXKTKSHYXXTTSVPPIIPQASEIGXGKSFKSCRCHVGLXXSSSSHALXVCXVPHHWPSGHXCSGLAEVCRGRXDTESLSANCDSSKGGGLREDPPETNKETPKAY

SEQ ID NO: 83 - protein, 1422 aa
AHPTGSIHPITVDAANDQDIYQPPCGAGSLTRCSCGETKGYLVTRLGSLVEVNKSDDPYWCVCGALPMAVAKGSSGAPILCSSGHVIGMFTAARNSGGSVGQIRVRPLVCAGYHPQYTAHATLDTKPTVPNEYSVQILIAPTGSGKSTKLPLSYMQXKXEVLVLNPSVATTASMPKYMHATYGVNPNCYFNGKCTNTGASLTYSTYGMYLTGRCSRNYDVIICDECHATDRTTVLGIGKVLTEAPSKNVRLVVLATATPPGVIPTPHANITEIQLTDEGTIPFHGKKIKEENLKKGRHLIFEATKKHCDELANELARKGITAVSYYRGCDISKMPEGDCVVVATDALCTGYTGDFDSVYDCSLMVEGTCHVDLDPTFTMGVRVCGVSAIVKGQRRGRTGRGRAGIYYYVDGSCTPSGMVPECNIVEAFDAAKAWYGLSSTEAQTILDTYRTQPGLPAIGANLDEWADLFSMVNPEPSFVNTAKRTADNYVLLTAAQLQLCHQYGYAAPNDAPRWQGARLGKKPCGVLWRLDGCDACPGPEPSEVTRYQMCFTEVNTSGTAALAVGVGVAMAYLAIDTFGATCVRRCWSITSVPTGATVAPVVDEEEIVEECASFIPLEAMVAAIDKLKSTITTTSPFTLETALEKLNTFLGPHAATILAIIEYCCGLVTLPDNPFASCVFAFIAGITTPLPHKIKMFLSLFGGAIASKLTDARXALAFMMAGAXGTALGTWTSVGFVFDMLGGYAGASSTACLTFKCLMGEWXTMDQLAGLVYSAFNPAAGVVGVLSACAMFALTTAGPDHWPNRLLTMLARSNTVCXEYFIATRDIRRKILGILEASTPWSXISACIRWLHTPTEDDCGLIAWGLXIWQYVCNFFVICFNVLKAGVQSMVNIPGCPFYSCQKGYKGPWIGSGMLQARCPCGAELIFSVENGFAKLYKGPRTCSNYWRGAVPVNARLCGSARPDPTDWTSLVVNYGVRDYCKYEKLGDHIFVTAVSSPNVCFTQVPPTLRAAVAVDRVQVQXYLGEPKTPWTTSACCYGPDGKGKTVKLPFRVDGHTPGGRMQLNLRDRLEANDCNSINNTPSDEAAVSALVFKQELRRTNQLLEAISAGVDTTKLPAPSQIEEVVVRKRQFRARTGSLTLPPPPRSVPGVSCPESLQRSDPLEGPSXLPSSPPVLQLAMPMPLLGAGECNPFTAIGCAMTETXGXPXXLPSYPPKKEVSEWSDESWSTTTTASSYVTGPPYPKIRGKDSTQSATAKRPTKKKLGKSEFSCSMSYTWTDVISFKTASKVLSATRAITSGFLKQRSLVYVTEPRDAELRKQKVTINRQPLFPPSYHKQVRLAKEKASKVVGVMWDYDEVAAHTPSKSAKSHITGLRGTDVLDLQKCVEAGEIPSHYRQTVIVPKEEVFVKTPQKPTKKPPRLI

SEQ ID NO: 84 - protein, 1422 aa
DKPWGFLCWFLGGLHEDLLLWNYHSLPIMTRYLTCLDTLLQVQNISAPKASDVGLSRLRGRVSCYFIIVPHDTDNFXSFFLSQSHLLVVXWGEQRLSINSDFLFSKLRIPRLSHIHQXSLFEETTSDGPSCRQNFRSSFEANHVGPSVAHAARKLTLSQLLFCRPFGGGXLSGILAPYLRVRGASNVAGSGCSRXPTFVXPFRDLLFGRVTGXIXXXSXCFGHCTSNCSERVTLTCSQQGHRHGQLXNRWXRREXXRTFXRVTSLQAFRTXHSWDGSRRGRQGKRTSSCPELALSYHYLFDLGGGWQFGGVNASXNCLKQLVCTPQLLFENKSGHCGFITRSVVYGITVICLKSITQIKLHATTRCVSVNAEGKLNSFTLTVRTVTASRCRPRSFGLTXITLNLYAVHGHCSSQGWGHLGETDIWRGYCCNKNVISQFLIFTVVPNAIIDDKTSPISWVRSSRPTQPSVDWNSPSPVIXTSSGSFVKFCKTILNRKDEFSTAWTACLEHTXSNPGALVPLLAAVERTTRNVNHALNSSFKDIKANHKEIAHILPNLXTPSNEAAIILRRGVXPTDASXYDTPGGRCLQNAQYLPADVTSGNKVLXTYSVAPSKHSKKSVGPVIWPCCCQSKHCTSXQDAHNSCGRIERGVDXTSKLIHSXPLTHQAFKCQASSGXGASIAAXHVKDKTHRCPCTKSCSXSPGHHERQCXSSVCKLGRNCASKXXQEHFDLVRXWGSNTRNESKHAXCKGIVRXSDXATAILYDSKDCSCMRPKKGVKFFKGGFQCERTSCGDCTLQLVNCSNHGLQGNEXCTLLHDFLFVNHWGDSSTGRDXCNRPATPHTSGAKSVNGXISHSHSNANSECGCPRSIDFSEAHLVSGHLAGLWARTGVTAVQAPQNPTRFFPKPGSLPPWCVIGSSIAILMTQLXLGCSQQNIIVSSSFCSIDKXRFGVDHRKEISPLVQICSYRRXPRLGAIGVQNSLSFCXXQTIPCLGCVEGFNNVAFRNHTRRGTTPVYIVVYASSPTACAAPTLAFNYCXNPAHTNTHGESRVKVNMACAFYHEAAVIHGIKVTSVPCTQGISGNYYTVALRHFXDVTSPIVRDSCYSLSSXLVSKLITVFFGSLKDKVSPFLQIFLLNLFSMKGDSAFIXXLNLSYVGMWCRDYSRGGSRGKNHXPNIFGWSFGXDLSNAQHGGSIGSMAFVTNDYIIVPGTSSGQVHAICAVRKXSPCVGTFAIKIAIWIHAVRRVHVLWHXCCCSHTGIXDQDLXLXLHVRKWXFGXLAAASGGNXNLHXILVRHSRFCIKSGMCCVLGMVSSTHQRPNPNLADXTARISSSGEHPNNMPGGAQNRGTXRTLGNSHGKGPAHTPIRVIGFVDLNQXPQSCYQIPLGLPARAPSKGPSSTWWLIDVLVISRVNGYWVYGACGMS

SEQ ID NO: 85 - protein, 1422 aa
ISLGGFFVGFWGVFTKTSSFGTITVCRXXLGISPASTHFCKSRTSVPRRPVMWDLADLEGVXAATSSXSHMTPTTFEAFSLANLTCLWYDGGNRGCLLIVTFCFLSSASRGSVTYTNDLCLRKPLVMARVADRTLEAVLKLITSVQVXLMLHENSLFPNFFFVGRLAVADXVESLPRILGYGGPVTXLEAVVVVDQLSSDHSETSFLGGXLGKXXGXPXVSVIAHPIAVKGLHSPAPNRGIGMANCRTGGEEGRXEGPSNGSLRCRLSGHDTPGTDLGGGGKVSEPVLARNWRFLTTTSSIWEGAGSLVVSTPAEIASSNWFVRRNSCLKTRADTAASSLGVLFMELQSFASSRSRKLSCMRPPGVCPSTRKGSLTVLPLPSGPXQQADVVQGVLGSPRXXXTCTRSTATAALKVGGTWVKQTFGEDTAVTKMXSPNFSYLQXSLTPXLTTRLVQSVGSGLADPHSLALTGTAPLQXFEQVLGPLXSFAKPFSTEKMSSAPHGQRAWSIPDPIQGPLYPFWQLXKGQPGMLTMLXTPALRTLKQITKKLHTYCQIXRPQAMRPQSSSVGVXSQRMQADMXLQGVDASRMPSIFLRMSRVAIKYSXHTVLLLASIVRSLLGQXSGPAVVKANIAQADKTPTTPAAGLNAEXTKPASXSIVXHSPIKHLNVKQAVDEAPAXPPSMSKTKPTDVHVPRAVPXAPAIMNASAXLASVSLDAIAPPNNDRNILILXGSGVVIPAMKANTHDAKGLSGKVTKPQQYSMIARIVAAXGPRKVLSFSRAVSNVKGLVVVIVLFSLSIAATMASKGMNDAHSSTISSSSTTGATVAPVGTDVIDQQRRTQVAPKVSMARXAIATPTPTASAAVPEVLTSVKHIWYLVTSLGSGPGQASQPSKRHRTPQGFFPSRAPCHRGASLGAAXPYXXHSCSWAAVNKTXLSAVLFAVLTNEGSGLTIEKRSAHSSKFAPIAGNPGWVRXVSRIVXASVDDKPYHALAASKASTMLHSGTIPEGVQLPSTXXYMPALPRPVRPLRWPLTIAETPHTRTPMVKVGSRSTWHVPSTMRLQSYTESKSPVYPVHKASVATTTQSPSGIFEMSHPLXXETAVIPFRANSLASSSQCFLVASKIRCLPFFRFSSLIFFPXKGIVPSSVNXISVMLACGVGITPGGVAVARTTSLTFLDGASVRTFPMPNTVVRSVAWHSSQMITSXFREHRPVRYMPYVLYVSEAPVLVHLPLKXQFGFTPYVACMYFGIDAVVATLGFRTKTSXFXCMXESGNLVDLPLPVGAIKICTEYSLGTVGFVSRVACAVYWGWYPAHTNGLTLIWPTEPPEFLAAVNIPITCPEEHRIGAPEEPLATAMGRAPHTHQXGSSDLLTSTNDPSRVTRYPLVSPQEHRVRDPAPHGGXXMSWSLAASTVIGCMEPVGXA

SEQ ID NO: 86 - protein, 1422 aa
XALGVSLLVSGGSSRRPPPLELSQFADNDSVSHLPRHTSASPEHQCPEGQXCGTXQTXRACELLLHHSPTXHRQLLKLFPXPISLACGMMGGTEVVYXXXLFVFXAPHPAAQSHTPMIFVXGNHXXWPELQTELXKQFXSXSRRSKCSSCCTKTHSFPTSFLXAVWRWLIEWNPCPVSXGTGGQXRSWKRLXSLTNFRLTIQRPPFWEGNWVNXXGLXXFRSLHIQLQXKGYTHLLPTGASAWPTXEQVVKKGGLKDLLTGHFVAGFQDMTLLGRISEGEARXANQFLPGTGAFLPLPLRSGRGLAVWWCQRQLKLPQAIGLYAATPVXKQERTLRLHHXECCLWNYSHLPQVDHANXVACDHQVCVRQRGREAXQFYPYRQDRNSKQMSSKEFWAHLDNXEPVRGPRPLQLSRLGAPGXNRHLERILLXQKCDLPISHIYSSPXRHNXRQDXSNQLGPVXPTHTAXRXLEQPLSSNLNKFWVLCKVLQNHSQQKRXVQHRMDSVLGAYLIQSRGPCTPSGSCRKDNQECXPCSELQLXGHXSKSQRNCTHTAKSXDPKQXGRNHPPSGCXANGCKLIXXSRGXMPPECPVSSCGCHEWQXSTHYIQCCSXQAXXEVCWASDLALLLSKQTLHKLTRRPQLLRPDXTRSRLNQQADPXXATHPSSIXMSSKQWMRRQHSRLACQRQNPPMSMYQELFPQPRPSXTPVRLXRLXAWTQLRLQIMTGTFXSCEVVGXXYPQXKQTRMMQRDCQVKXLSHSNTLXXQGLXLHEAQERCXVFQGRFPMXKDXLWXLYSSACQLQQPWPPREXMMHTPPRFPLRQPLGRQXHRXGLMXXTSNAAHKWRQKCQWLDKPXPLQRQQRVRLSQKYXLQXSTFGIWSPRWALGQDRRHSRPSATEPHKVFSQAGLPATVVRHWEQHSHTDDTVVVGLQSTKHNCQQFFLQYXQMKVRGXPXKRDQPTRPNLLLSQVTQVGCDRCPEXFELLLMTNHTMPWLRRRLQQCCIQEPYPKGYNSRLHSSICQLSHGLCGPYAGLXLLLKPRTHEHPWXKXGQGQHGMCLLPXGCSHTRNQSHQCTLYTRHQWQLLHSRPQAFLRCHIPYSKRQLLFPFELTRXQAHHSVFWXPQRXGVSLSSDFPPXSFFHERGXCLHXLIESQLCWHVVXGLLQGGXPWQEPLAXHFWMELRLGPFQCPTRWFDRXHGIRHKXLHHSSGNIVRSGTCHMCCTXVKPLCWYICHXNSNLDSRRTSRACTLALMLLXPHWDLGPRPHXSPACKKVVIWLTCRCQWGQLKFALNTRXAQXVLYQEWHVLCTGDGIQHTPTAXPXSGRLNRQNFXQRXTSQXHARRSTESGHLKNPWQQPWEGPRTHTNKGHRICXPQPMTPVVLPDTPWSPRKSTEXGTQLHMVVDRCPGHXPRQRLLGVWSLWDEP

SEQ ID NO: 87 - DNA (genomic), 20 bp; single-stranded, linear
ctaccaccaataccagcggc

SEQ ID NO: 88 - DNA (genomic), 22 bp; single-stranded, linear
gacatggtcctggccctgttgg

SEQ ID NO: 89 - DNA (genomic), 21 bp; single-stranded, linear
gatccatagtgagccactcac

SEQ ID NO: 90 - DNA (genomic), 23 bp; single-stranded, linear
caaaatgttcctgtcattatttg

SEQ ID NO: 91 - DNA (genomic), 21 bp; single-stranded, linear
caatcatctccagctataaag

SEQ ID NO: 92 - DNA (genomic), 20 bp; single-stranded, linear
ctgtggacgccacttgtttc

SEQ ID NO: 93 - DNA (genomic), 21 bp; single-stranded, linear
caatagcacaatcttccttgg

SEQ ID NO: 94 - DNA (genomic), 20 bp; single-stranded, linear
gaaagcttggttggttgtgg

SEQ ID NO: 95 - DNA (genomic), 22 bp; single-stranded, linear
catcttgacaatgacaactttc

SEQ ID NO: 96 - DNA (genomic), 20 bp; single-stranded, linear
cctcactcaccttcgacctc

SEQ ID NO: 97 - DNA (genomic), 20 bp; single-stranded, linear
ggttggcacttgcatgcctg

SEQ ID NO: 98 - DNA (genomic), 20 bp; single-stranded, linear
cctggctttgttcccactgc

SEQ ID NO: 99 - DNA (genomic), 20 bp; single-stranded, linear
ctcgtacccctcctggcagc

SEQ ID NO: 100 - DNA (genomic), 20 bp; single-stranded, linear
gctaggagcaacactgtatg

SEQ ID NO: 101 - DNA (genomic), 27 bp; single-stranded, linear
cgccataattgacgacaagactagtcc

SEQ ID NO: 102 - DNA (genomic), 23 bp; single-stranded, linear
ctattcccaggctatagctaaag

SEQ ID NO: 103 - DNA (genomic), 26 bp; single-stranded, linear
caggtacatgccatatgtgctgtacg

SEQ ID NO: 104 - DNA (genomic), 20 bp; single-stranded, linear
cttggacgcaattgcgcctc

SEQ ID NO: 105 - DNA (genomic), 21 bp; single-stranded, linear
gtcactaggtaactgatgttg

SEQ ID NO: 106 - DNA (genomic), 21 bp; single-stranded, linear
catggtggttgatagatgtcc

SEQ ID NO: 107 - DNA (genomic), 20 bp; single-stranded, linear
gtgtcaaaagctaagcaggc

SEQ ID NO: 108 - DNA (genomic), 19 bp; single-stranded, linear
agataccccttggtctccc

SEQ ID NO: 109 - DNA (genomic), 20 bp; single-stranded, linear
caggatctattccagtaggc

SEQ ID NO: 110 - DNA (genomic), 22 bp; single-stranded, linear
gtataggggtaccaagatatgg

SEQ ID NO: 111 - DNA (genomic), 25 bp; single-stranded, linear
gtctgctaagtcccacatcactggc

SEQ ID NO: 112 - DNA (genomic), 20 bp; single-stranded, linear
catgaagaaccctcgcttcc

SEQ ID NO: 113 - DNA (genomic), 21 bp; single-stranded, linear
cacccaacccgaggactccag

SEQ ID NO: 114 - DNA (genomic), 22 bp; single-stranded, linear
cacttcagcgcatgccaatagc

SEQ ID NO: 115 - DNA (genomic), 23 bp; single-stranded, linear
gtactaaacccatccattgccac

SEQ ID NO: 116 - DNA (genomic), 20 bp; single-stranded, linear
gccgaatgagtacgtcaagg

SEQ ID NO: 117 - DNA (genomic), 21 bp; single-stranded, linear
gtaggtgtggccgtgggaaag

SEQ ID NO: 118 - DNA (genomic), 20 bp; single-stranded, linear
ctgccgaactgagggctcag

SEQ ID NO: 119 - DNA (genomic), 24 bp; single-stranded, linear
ggttaccgttcccattgacaaccc

SEQ ID NO: 120 - DNA (genomic), 23 bp; single-stranded, linear
ggacggggtctctggttgtagtg

SEQ ID NO: 121 - DNA (genomic), 24 bp; single-stranded, linear
gtgaaccgcgctcactcaccttcg

SEQ ID NO: 122 - DNA (genomic), 21 bp; single-stranded, linear
cctctagagcggcctgagcag

SEQ ID NO: 123 - DNA (genomic), 20 bp; single-stranded, linear
ggattaaggcaccatcattc

SEQ ID NO: 124 - DNA (genomic), 23 bp; single-stranded, linear
gcacgattggatgccggggatac

SEQ ID NO: 125 - DNA (genomic), 34 bp; single-stranded, linear
cagttcaagcttgtccaggaattcnnnnnccggt

SEQ ID NO: 126 - DNA (genomic), 24 bp; single-stranded, linear
cagttcaagcttgtccaggaattc

SEQ ID NO: 127 - DNA (genomic), 20 bp; single-stranded, linear
gcctcagccaacttcatcac

SEQ ID NO: 128 - DNA (genomic), 34 bp; single-stranded, linear
cagttcaagcttgtccaggaattcnnnnngcgct

SEQ ID NO: 129 - DNA (genomic), 22 bp; single-stranded, linear
gcgctgagcctgttagcataac

SEQ ID NO: 130 - DNA (genomic), 20 bp; single-stranded, linear
caggcggtggtattgtcagc

SEQ ID NO: 131 - DNA (genomic), 23 bp; single-stranded, linear
cactttggactgtaacaaatgac

SEQ ID NO: 132 - DNA (genomic), 21 bp; single-stranded, linear
catccacccgataaaccctag

SEQ ID NO: 133 - DNA (genomic), 24 bp; single-stranded, linear
cttgcagaagtgtgtcgaggcagg

SEQ ID NO: 134 - DNA (genomic), 21 bp; single-stranded, linear
taatgctgcagccgacagctg

SEQ ID NO: 135 - DNA (genomic), 34 bp; single-stranded, linear
cagttcaagcttgtccaggaattcnnnnnggcct

SEQ ID NO: 136 - DNA (genomic), 20 bp; single-stranded, linear
ctttctcggtggtgcgctac

SEQ ID NO: 137 - DNA (genomic), 20 bp; single-stranded, linear
caacgctgagatcctcagag

SEQ ID NO: 138 - DNA (genomic), 21 bp; single-stranded, linear
ccgtgagaggcgactggtgag

SEQ ID NO: 139 - DNA (genomic), 24 bp; single-stranded, linear
cgcaggacagtagacaccttggtg

SEQ ID NO: 140 - DNA (genomic), 23 bp; single-stranded, linear
caggcatcaccgaactgcgtggc

SEQ ID NO: 141 - DNA (genomic), 23 bp; single-stranded, linear
cgagtgacgcttggtgcctggtc

SEQ ID NO: 142 - DNA (genomic), 20 bp; single-stranded, linear
caccttgctgccgtatccag

SEQ ID NO: 143 - DNA (genomic), 24 bp; single-stranded, linear
ccaatcggcagtgctttagggacc

SEQ ID NO: 144 - DNA (genomic), 23 bp; single-stranded, linear
gtatccccggcatccaatcgtgc

SEQ ID NO: 145 - DNA (genomic), 22 bp; double-stranded, linear
caaccatcccaacacatgtagg

SEQ ID NO: 146 - DNA (genomic), 20 bp; double-stranded, linear
gggcttgcccaactacttcc

SEQ ID NO: 147 - DNA (genomic), 21 bp; double-stranded, linear
ggaggcgtgatactcaaaaag

SEQ ID NO: 148 - DNA (genomic), 21 bp; double-stranded, linear
ccgtgagaggcgactggtgag

SEQ ID NO: 149 - DNA (genomic), 21 bp; double-stranded, linear
cacccaacccgaggactccag

SEQ ID NO: 150 - DNA (genomic), 21 bp; double-stranded, linear
cagcaaccacacagccaagcc

SEQ ID NO: 151 - DNA (genomic), 20 bp; single-stranded, linear
gggcttgcccaactacttcc

SEQ ID NO: 152 - DNA (genomic), 21 bp; single-stranded, linear
taatgctgcagccgacagctg

SEQ ID NO: 153 - DNA (genomic), 21 bp; single-stranded, linear
ggaggcgtgatactcaaaaag

SEQ ID NO: 154 - DNA (genomic), 20 bp; single-stranded, linear
catgaagaaccctcgcttcc

SEQ ID NO: 155 - DNA (genomic), 28 bp; double-stranded, linear
ccaagtcaagcttggcgcttgtcatcac

SEQ ID NO: 156 - DNA (genomic), 20 bp; single-stranded, linear
caacgctgagatcctcagag

SEQ ID NO: 157 - DNA (genomic), 21 bp; single-stranded, linear
gatccatagtgagccactcac

SEQ ID NO: 158 - DNA (genomic), 221 bp; single-stranded, linear; identical to SEQ ID NO: 21

SEQ ID NO: 159 - DNA (genomic), 337 bp; single-stranded, linear; identical to SEQ ID NO: 29

SEQ ID NO: 160 - DNA (genomic), 20 bp; single-stranded, linear
cctcactcaccttcgacctc

SEQ ID NO: 161 - DNA (genomic), 306 bp; single-stranded, linear; identical to SEQ ID NO: 27

SEQ ID NO: 162 - DNA (genomic), 20 bp; single-stranded, linear
gtgtcaaaagctaagcaggc

SEQ ID NO: 163 - DNA (genomic), 9493 bp; single-stranded, linear
cgtgggagtccggggccccggacctcccaccgaggtggggggaaaggggccctggaccggccgggtggaaggcccggaaccggtccatcttcctcaaggttgaggaaggggtacgtctatcggtccggtcggtccgaaaggcgtctggatgcctagtgttagggttcgtaggtggtaaatcccagctaggcgtgaaagcgctataggataggcttatcccggtgaccgctgccccggaaccagccccgcggktctttggacacggtccacaggttgggggtaccggtgtgaataaccccccgactgaagcgtcagtcgttaaacggagacggtctcctgagatcgcaacgacgccccacgtacgggaacgccgccaaaaccttcgggacagctatgcgggttgacaatcccagtggggggccggggaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgcttccccctcgcggggggggtgctcttcaactcgcggcaccagtgcttcaatggggaccattatgtgctttccaattgttgttcccgagacgaggtttacttctgtttcggggacggatgtctggtggcttatggctgtactgtttgcacacagtcttgctggaagctctaccggcctggggtggctactcggcccgggtccgaaccaggtgagctgctggggagatttgggagtgtaattggtccggtgtcggcttcggcttacaccgctggagtcctcgggttgggtgaaccttacagtttggccttcttggggacgttcctcaccagtcgcctctcacggattcccaacgtcacctgcgtgaaggcttgtgaccttgagtttacctacccaggcttgtccatcgattttgactgggcgtttaccaagatcttgcagttgccggccaagctgtggcgaggcctaacggcrgcwccggtcttgagcctcctcgtgatcctcatgctggtcctcgagcagcgcctcctgatagccttcctactgcttttggtagtgggcgaggctcagagggggatgttcgacaactgcgtgtgtggttactgggggggcaagaggcccccgtcggtgaccccgctgtaccgtggcaacggtactgtggtgtgtgactgtgattttggaaaaatgcattgggccccccccttgtgttccggyctggtgtggcgggacggtcataggaggggcaccgtgcgcgacctccccccggtttgcccccgggaggttctcggcacggtgacagtcatgtgtcagtggggttctgcctactggatttggagatttggggactgggttgcattgtacgacgagctaccacgatcagctctctgtactttcttctcaggtcatggtccacaacctaaagatctctcagtcttgaatccatccggggcaccttgtgcttcttgcgtcgttgaccagaggccgctgaaatgtggttcctgcgtccgcgactgctgggagacggggggtcctgggttcgatgagtgcggtgtcggtactcggatgacgaagcacctcgaggccgtcctggttgatggaggtgtggagtccaaggtgacaacgcccaagggtgagcgccccaaatacataggtcagcacggtgtgggaacctactacggcgctgtccgtagcctcaacatcagttacctagtgactgaggtggggggctattggcatgcgctgaagtgcccgtgcgactttgtgccccgagtgctcccagaaagaattccaggtaggcctgtgaatgcatgtctagctgggaagtctccgcacccgttcgcaagttgggctcccggtgggttttacgcccccgtgttcaccaagtgcaactggccgaagacctccggagtggatgtgtgtcctgggtttgctttcgatttccctggtgatcacaacggcttcatccatgttaaaggcaacagacagcaggtttacagtggtcagcgaaggtcttcgccggcttggttgcttactgacatggtcctggccctgttggtggtgatgaagttggctgaggctagagttgtccccctgtttatgctggcaatgtggtggtggttgaatggagcatctgctgccactattgtcatcatacaccctactgtcacgaagtccactgaaagtgttccattgtggactccgcccactgttccaactccatcttgcccgaattctaccaccggagtcgcggactctacctacaatgctggttgctacatggtggcaggcctggcggccggggctcaggcggtctggggtgctgccaatgatggtgctcaggccgtcgttggtggcatctggcccgcgtggctcaagctgcgaagcttcgctgccggtctggcctggttgtcaaatgttggggcttacttgccggtcgtcgaggccgcvctggctcccgagctggtgtgcaccccggtggtcggctgggcagcccaggagtggtggttcactggttgtctgggtgtgatgtgtgtcgtggcgtacctgaatgtcctgggctctgtragggctgccgtgcttgtggcgatgcacttcgcaaggggtgctctgccgctggtattggtggtagctgccggggtracccgggagcggcacagcgtcttagggcttgaggtgtgcttcgatctggatggtggagactggccrgacgccagttggtcttggggtttagcaggcgtggtgagctgggccctcctggtggggggtctgatgacccacggtggccgatcagccagaytgacttggtaygccaggtgggccgtcaattaycagagggttcgycggtgggtgaacaactcaccggttggagcytttggycgttggmggcgygcctggaaagcytggttrgtkgtggcttggttcttcccccagacagttgccacagtytccgtcatcttcatactctgtttgagcagtttagatgtcattgatttcatcttggargtactcttggttaactcaccaaatctcgcgcgcttggcgcgrgtgctggactccttagctcthgctgaggagcggctggcctgctcttggctggtgggcgtcctgcgcaagcggggcgtcctcctctacgagcacgcyggtcacactagcaggcgcggtgctgcccgcttgcgagagtggggytttgcgctygagcckgttagyataaccaaggaagattgygcyattgttcgggactctgctcgtgtgttgggctgtggacaattggtccatgggaaaccagtggtcgcgaggcgaggcgacgaggtgttgatcggctgtgtgaacagtcggttcgaccttccgcctggctttgttcccactgctcccgtggtscttcatcargcwggcaarggrttyttyggggttgtgaagacmtccatgacaggcaaggacccgtccgaacaccacggraacgtggtggtcctwgggacttcaacaackcgttccatgggctgctgcgtgaacggagtagtgtacacracataccatggyaccaacgcccgrcckatggcggggccktttggkccygtcaaygctcggtggtggtcwgcgagygacgacgtcacggtytacccgctcccwaatggygcttcttgcctycargcwtgyaagtgccaaccaactggggtgtgggtgatccggaatgacggagctctttgccatggaactctcggcaaggtggtggatttagatatgcccgctgagttgtcagactttcgcgggtcttctggatcaccaatcttgtgcgatgagggtcatgctgttggcatgctgatttcggtgcttcatagggggagtagggtttcctcggtgcggtataccaaaccttgggaaactctccctcgggagattgaggctcgatcggaggccccccctgtgccaggaaccactggatacagggaggcgccactgttcctgcccaccggagctggcaagtcgacgcgcgtgccgaatgagtacgtcaaggctggacacaargtgcttgtactaaacccatccattgccacagtgagggccatgggcccttacatggaaaagttaaccggcaaacatccgtcggtgtactgtggccatgacactactgcatattccaggactactgactcatctttgacctactgtacatacggcaggtttatggccaatcccaggaaatacttgcgggggaacgacgtcgtaatttgcgacgagttgcacgtcaccgacccgacctcaattttggggatgggtcgggcgaggttactcgctcgcgagtgcggcgtacgcctcctgcttttcgctacggcgaccccaccggtctctccgatggcgaagcatgaatctattcatgaggagatgttgggcagtgagggggaggtccccttctattgccaattcctcccactgagtaggtatgctactgggagacacctgctgttttgtcattccaaggtagartgcactaggttatcctcagctttggccagctttggtgtcaacaccgttgtgtacttcagaggcaaagaaactgacattccaactggtgacgtgtgcgtttgcgccacagacgcactttccactggttacactggcaattttgacaccgtaacagactgtggtttaatggttgaggaggtagtggaagtgaccctggacccgaccatcactatcggtgtgaagaccgtcccggcccctgccgaactgagggctcagaggcgtggtaggtgtggccgtgggaaagcgggcacttactatcaggcattgatgtcttcggcgccggcgggaacsgttcggtctggggctctctgggcagctgttgaggctgghgtctcgtggtatggcctagagcccgatgctattggagacctgcttagggcctacgactcgtgtccttatactgctgccatcagtgcgtccatcggagaggccattgccttttttactggyctagtgccaatgaggaattatcctcaggtggtttgggccaagcagaagggrcacaactggccactcttggtgggtgtgcagaggcacatgtgtgaggacgcgggctgtggtcckcccgctaatggtcccgaatggagcggcatcaggggaaaagggcctgttcccctgttgtgccgatggggtggtgacttgcctgagtcggtggctccgcatcactgggttgatgacctacaggcccggctcggtgtggccgagggttacactccctgcattgctggaccggtgcttttggtcggtttggcgatggcggggggggctatcctggcacactggacggggtctctggttgtagtgaccagttgggttgtcaatgggaacggtaacccgctgatacaaagcgcctctaggggcgtggckacyagcggtccatacccagtacccccagatggtggtgaacggtacccatcagacatcaagccaatyactgaggctgtgaccacccttgagactgcgtgcggytggggcccagccgcggcbagtctggcttatgtgaaggcctgtgaaactggaaccatgttggctgacaargcgagtgctgcgtggcaggcttgggctgcaaacaactttgtgcctccaccagcatcacactcaacttccttgttrcagagcttggaygctgcgttcacttcagcttgggatagcgtgttcactcacggccgttccttgcttgttgggttcacagctgcttacggcgctcggcggaacccaccgctgggcgtcggagcctctttcttgctgggcatgtcatcgagccacytractcacgtcagacttgctgctgcgttgctcctcggcgtcgggggtaccgtcctaggcacgcctgctactgggcttgctatggcgggtgcctacttcgckgggggcagcgttaccgctaactggctgagtatcattgtggctctaatcggaggctgggagggggcrgtkaacgcagcctcactcaccttcgayctcctggckgggaagttacaagckagygaygcttggtgcctrgtcagytgcytggcctctccgggggcttcggtggcyggtgtggcdctvggyctdytgctvtggtctgtcaaraagggtgtgggwcargaytgggttaacagaytgttgacgatgatgccacgcagttcggtgatgcctgacgatttcttcctcaaagatgagttcgtcaccaaggtgtctactgtcctgcgaaagttgtcattgtcaagatggatcatgactcttgtggacaagcgggagatggagatggagacmcccgcttctcagattgtttgggacttgcttgactggtgcatccggctrggtcggttcctgtacaataaactyatgtttgctctccctaggttgcgcctgccgcttatcggttgcagtaccggttggggtggcccgtgggagggcaatggtcatttggaaacaaggtgtacttgtggctgtgtgattaccggtgatattcacgatggtatattgcacgacctacattatacctccctactgtgcagacattactacaagaggacagtgcctgttggcgtcatgggcaatgctgagggagcagtcccccttgtgcctactggcggtggaatcaggacttaccaaattgggacttctgactggtttgaggctgtggtcgtgcatgggacaatcacggtgcacgccaccagttgctatgagttgaaagctgctgacgttcggagggcggtgcgagccggcccgacttacgttggtggcgtaccttgcagctggagcgcgccgtgtactgcgcctgcgctcgtttacaggctaggccagggcatcaaaatcgatggagcgcgccgactgttgccctgtgacttagcacagggagcgcgccaccccccggtatctggcagtgttgccggtagtggttggacagatgaggacgagagggacttggtggaaaccaaggctgccgccatcgaggccattggggcggccttgcacctcccttcaccggaggctgctcaggccgctctagaggctttggaggaggctgccgtgtccctgttgccccatgtgcccgtcattatgggtgatgactgttcatgccgggatgaggcgttccaaggccacttcatcccagaacccaatgtgacagaggtacccattgagcccacggtcggagacgtggaggcactcaagctgcgggctgcagacctgaccgccaggttgcaagacttggaggccatggctctcgcccgcgctgagtcaatcgaggatgctcgcgcagcttcgatgccttcgctcaccgaggtggactcaatgccatcattggagtcgagcccttgctcctcctttgaacaaatctctttaactgaaagtgaccctgagactgtcgtcgaggctggcttacccttggagttcgtgaactccaacaccgggccgtctccggctcggaggattgtcagaatccgacaggcttgctgttgtgacagatccacaatgaaggccatgccgttgtcgttcactgtcggggagtgcctcttcgttactcgctatgacccggacggtcaccaactgtttgacgagcgaggtccgatagaggtatctactcctatatgtgaagtgattggggacatcaggcttcagtgtgaccaaattgaggaaactccaacatcttactcttacatctggtcaggggcgcccttgggtactgggagaagtgtcccccaacccatgacgcgccctatagggacccatctgacttgtgacactaccaaagtttatgttactgaccctgatcgggccgctgagcgggccgagaaggttacaatctggaggggtgataggaagtatgacaagcattatgaggctgtcgttgaggctgtcctgaaaaaggcagccgcgacgaagtctcatggctggacctattcccaggctatagctaaagttaggcgccgagcagccgctggatacggcagcaaggtgaccgcctccacattggccactggttggcctcacgtggaggagatgctggacaaaatagccaggggacaggaagttcctttcacttttgtgaccaagcgagaggttttcttctccaaaactacccgtaagcccccaagattcatagttttcccacctttggacttcaggatagctgaaaagatgattctgggtgaccccggcatcgttgcaaagtcaattctgggtgacgcttatctgttccagtacacgcccaatcagagggtcaaagctctggttaaggcgtgggaggggaagttgcatcccgctgcgatcactgtggacgccacttgtttcgactcatcgattgatgagcacgacatgcaggtggaggcttcggtgtttgcggcggctagtgacaacccctcaatggtacatgctttgtgcaagtactactctggtggccctatggtttccccagatggggttcccttggggtaccgccagtgtaggtcgtcgggcgtgttaacaactagctcggcgaacagcatcacttgttacattaaggtcagcgcggcctgcaggcgggtggggattaaggcaccatcattctttatagctggagatgattgcttgatcatctatgaaaatgatggaactgatccctgccctgctcttaaggctgccctggccaactatggatacaggtgtgaaccaacaaagcatgcttcactggacacagctgagtgttgctcggcctacttggctgagtgcgtagctgggggtgccaagcgctggtggttgagcacggacatgaggaagccgctcgcaagggcgtcttccgaatattcggacccaatcggcagtgctttagggaccatcttgatgtatccccggcatccaatcgtgcggtatgttctaataccacacgtactaataatggcttacaggagtggcagcacaccggatgagttggttatgtgtcaggttcagggaaatcattactctttcccgctgcggctgctgcctcgcgtcttggtctctctacatggtccgtggtgcctacaagtcaccacggacagtacgaagactaggatggaggcaggctcagcsttgcgggatttaggaatgaaatccctagcctggcaccgccgacgtgccggaaatgtgcgcactcgcctcctgaggggaggcaaggagtgggggcacctggccagagccctcctctggcayccaggkttgaaggagcaycccccrcccataaattcacttccaggttttcagctggcgacgccttacgaacaccatgaagaggtcttgatctcgatcaagagtcgaccaccttggataaggtggattcttggtgcttgtctctcgttgctggccgccttgctgtgaattcgctccaggcagtaggaccttcgggtcggggg

SEQ ID NO: 164 - protein, 51 aa
RGSPGPRTSHRGGGKGALDRPGGRPGTGPSSSRLRKGYVYRSGRSERRLDA

SEQ ID NO: 165 - protein, 5 aa
VVNPS

SEQ ID NO: 166 - protein, 9 aa
KRYRIGLSR

SEQ ID NO: 167 - protein, 21 aa
PLPRNQPRXSLDTVHRLGVPV

SEQ ID NO: 168 - protein, 47 aa
ITPRLKRQSLNGDGLLRSQRRPTYGNAAKTFGTAMRVDNPSGGPGTS

SEQ ID NO: 169 - protein, 45 aa
LLVLRVPLETGRKAATGPPRRRSAACGKGKNPSGDPWWQSLPLGA

SEQ ID NO: 170 - protein, 94 aa
VWSTHSPWLGCGCWFASPSRGGCSSTRGTSASMGTIMCFPIVVPETRFTSVSGTDVWWLMAVLFAHSLAGSSTGLGWLLGPGPNQVSCWGDLGV

SEQ ID NO: 171 - protein, 41 aa
LVRCRLRLTPLESSGWVNLTVWPSWGRSSPVASHGFPTSPA

SEQ ID NO: 172 - protein, 33 aa
RLVTLSLPTQACPSILTGRLPRSCSCRPSCGEA

SEQ ID NO: 173 - protein, 5 aa
RXXRS

SEQ ID NO: 174 - protein, 10 aa
SSCWSSSSAS

SEQ ID NO: 175 - protein, 6 aa
PSYCFW

SEQ ID NO: 176 - protein, 24 aa
WARLRGGCSTTACVVTGGARGPRR

SEQ ID NO: 177 - protein, 54 aa
PRCTVATVLWCVTVILEKCIGPPPCVPXWCGGTVIGGAPCATSPRFAPGRFSAR

SEQ ID NO: 178 - protein, 46 aa
QSCVSGVLPTGFGDLGTGLHCTTSYHDQLSVLSSQVMVHNLKISQS

SEQ ID NO: 179 - protein, 16 aa
IHPGHLVLLASLTRGR

SEQ ID NO: 180 - protein, 25 aa
NVVPASATAGRRGVLGSMSAVSVLG

SEQ ID NO: 181 - protein, 16 aa
RSTSRPSWLMEVWSPR

SEQ ID NO: 182 - protein, 10 aa
QRPRVSAPNT

SEQ ID NO: 183 - protein, 19 aa
VSTVWEPTTALSVASTSVT

SEQ ID NO: 184 - protein, 9 aa
LRWGAIGMR

SEQ ID NO: 185 - protein, 19 aa
SARATLCPECSQKEFQVGL

SEQ ID NO: 186 - protein, 3 aa
MHV

SEQ ID NO: 187 - protein, 81 aa
LGSLRTRSQVGLPVGFTPPCSPSATGRRPPEWMCVLGLLSISLVITTASSMLKATDSRFTVVSEGLRRLGCLLTWSWPCWW

SEQ ID NO: 188 - protein, 18 aa
SWLRLELSPCLCWQCGGG

SEQ ID NO: 189 - protein, 134 aa
MEHLLPLLSSYTLLSRSPLKVFHCGLRPLFQLHLARILPPESRTLPTMLVATWWQAWRPGLRRSGVLPMMVLRPSLVASGPRGSSCEASLPVWPGCQMLGLTCRSSRPXWLPSWCAPRWSAGQPRSGGSLVVWV

SEQ ID NO: 190 - protein, 6 aa
CVSWRT

SEQ ID NO: 191 - protein, 26 aa
MSWALXGLPCLWRCTSQGVLCRWYWW

SEQ ID NO: 192 - protein, 11 aa
LPGXPGSGTAS

SEQ ID NO: 193 - protein, 21 aa
GLRCASIWMVETGXTPVGLGV

SEQ ID NO: 194 - protein, 8 aa
AGPSWWGV

SEQ ID NO: 195 - protein, 8 aa
PTVADQPX

SEQ ID NO: 196 - protein, 16 aa
LGXPGGPSIXRGFXGG

SEQ ID NO: 197 - protein, 39 aa
TTHRLEXLXVXGXPGKXGXXWLGSSPRQLPQXPSSSYSV

SEQ ID NO: 198 - protein, 26 aa
MSLISSWXYSWLTHQISRAWRXCWTP

SEQ ID NO: 199 - protein, 45 aa
LXLRSGWPALGWWASCASGASSSTSTXVTLAGAVLPACESGXLRX

SEQ ID NO: 200 - protein, 4 aa
SXLX

SEQ ID NO: 201 - protein, 34 aa
PRKIXXLFGTLLVCWAVDNWSMGNQWSRGEATRC

SEQ ID NO: 202 - protein, 28 aa
TVGSTFRLALFPLLPWXFIXXAXXXXGL

SEQ ID NO: 203 - protein, 26 aa
QARTRPNTTXTWWSXGLQQXVPWAAA

SEQ ID NO: 204 - protein, 54 aa
CTXHTMXPTPXXWRGXLXXSXLGGGXRXTTSRXTRSXMXLLAXXXXSANQLGCG

SEQ ID NO: 205 - protein, 17 aa
SGMTELFAMELSARWWI

SEQ ID NO: 206 - protein, 27 aa
ICPLSCQTFAGLLDHQSCAMRVMLLAC

SEQ ID NO: 207 - protein, 71 aa
FRCFIGGVGFPRCGIPNLGKLSLGRLRLDRRPPLCQEPLDTGRRHCSCPPELASRRACRMSTSRLDTXCLY

SEQ ID NO: 208 - protein, 6 aa
THPLPQ

SEQ ID NO: 209 - protein, 9 aa
GPWALTWKS

SEQ ID NO: 210 - protein, 23 aa
PANIRRCTVAMTLLHIPGLLTHL

SEQ ID NO: 211 - protein, 21 aa
PTVHTAGLWPIPGNTCGGTTS

SEQ ID NO: 212 - protein, 68 aa
FATSCTSPTRPQFWGWVGRGYSLASAAYASCFSLRRPHRSLRWRSMNLFMRRCWAVRGRSPSIANSSH

SEQ ID NO: 213 - protein, 15 aa
VGMLLGDTCCFVIPR

SEQ ID NO: 214 - protein, 50 aa
XALGYPQLWPALVSTPLCTSEAKKLTFQLVTCAFAPQTHFPLVTLAILTP

SEQ ID NO: 215 - protein, 4 aa
QTVV

SEQ ID NO: 216 - protein, 4 aa
WLRR

SEQ ID NO: 217 - protein, 9 aa
PWTRPSLSV

SEQ ID NO: 218 - protein, 8 aa
RPSRPLPN

SEQ ID NO: 219 - protein, 19 aa
GLRGVVGVAVGKRALTIRH

SEQ ID NO: 220 - protein, 26 aa
CLRRRREXFGLGLSGQLLRLXSRGMA

SEQ ID NO: 221 - protein, 34 aa
SPMLLETCLGPTTRVLILLPSVRPSERPLPFLLX

SEQ ID NO: 222 - protein, 112 aa
GIILRWFGPSRRXTTGHSWWVCRGTCVRTRAVVXPLMVPNGAASGEKGLFPCCADGVVTCLSRWLRITGLMTYRPGSVWPRVTLPALLDRCFWSVWRWRGGLSWHTGRGLWL

SEQ ID NO: 223 - protein, 11 aa
PVGLSMGTVTR

SEQ ID NO: 224 - protein, 34 aa
YKAPLGAWXXAVHTQYPQMVVNGTHQTSSQXLRL

SEQ ID NO: 225 - protein, 18 aa
PPLRLRAXGAQPRXVWLM

SEQ ID NO: 226 - protein, 106 aa
RPVKLEPCWLTXRVLRGRLGLQTTLCLHQHHTQLPCXRAWXLRSLQLGIACSLTAVPCLLGSQLLTALGGTHRWASEPLSCWACHRAXXLTSDLLLRCSSASGVPS

SEQ ID NO: 227 - protein, 23 aa
ARLLLGLLWRVPTSXGAALPLTG

SEQ ID NO: 228 - protein, 5 aa
VSLWL

SEQ ID NO: 229 - protein, 65 aa
SEAGRGXXTQPHSPSXSWXGSYKXXXLGAXSXXWPLRGLRWXVWXXXXCXGLSXRVWXXXGLTXC

SEQ ID NO: 230 - protein, 5 aa
CHAVR

SEQ ID NO: 231 - protein, 21 aa
CLTISSSKMSSSPRCLLSCES

SEQ ID NO: 232 - protein, 7 aa
CHCQDGS

SEQ ID NO: 233 - protein, 72 aa
LLWTSGRWRWRXPLLRLFGTCLTGASGXVGSCTINXCLLSLGCACRLSVAVPVGVARGRAMVIWKQGVLVAV

SEQ ID NO: 234 - protein, 78 aa
LPVIFTMVYCTTYIIPPYCADITTRGQCLLASWAMLREQSPLCLLAVESGLTKLGLLTGLRLWSCMGQSRCTPPVAMS

SEQ ID NO: 235 - protein, 35 aa
KLLTFGGRCEPARLTLVAYLAAGARRVLRLRSFTG

SEQ ID NO: 236 - protein, 16 aa
ARASKSMERADCCPVT

SEQ ID NO: 237 - protein, 52 aa
HRERATPRYLAVLPVVVGQMRTRGTWWKPRLPPSRPLGRPCTSLHRRLLRPL

SEQ ID NO: 238 - protein, 38 aa
RLWRRLPCPCCPMCPSLWVMTVHAGMRRSKATSSQNPM

SEQ ID NO: 239 - protein, 21 aa
QRYPLSPRSETWRHSSCGLQT

SEQ ID NO: 240 - protein, 50 aa
PPGCKTWRPWLSPALSQSRMLAQLRCLRSPRWTQCHHWSRALAPPLNKSL

SEQ ID NO: 241 - protein, 17 aa
LKVTLRLSSRLAYPWSS

SEQ ID NO: 242 - protein, 25 aa
TPTPGRLRLGGLSESDRLAVVTDPQ

SEQ ID NO: 243 - protein, 31 aa
RPCRCRSLSGSASSLLAMTRTVTNCLTSEVR

SEQ ID NO: 244 - protein, 8 aa
RYLLLYVK

SEQ ID NO: 245 - protein, 36 aa
LGTSGFSVTKLRKLQHLTLTSGQGRPWVLGEVSPNP

SEQ ID NO: 246 - protein, 42 aa
LVTLPKFMLLTLIGPLSGPRRLQSGGVIGSMTSIMRLSLRLS

SEQ ID NO: 247 - protein, 16 aa
KRQPRRSLMAGPIPRL

SEQ ID NO: 248 - protein, 14 aa
LKLGAEQPLDTAAR

SEQ ID NO: 249 - protein, 18 aa
PPPHWPLVGLTWRRCWTK

SEQ ID NO: 250 - protein, 10 aa
PGDRKFLSLL

SEQ ID NO: 251 - protein, 17 aa
PSERFSSPKLPVSPQDS

SEQ ID NO: 252 - protein, 8 aa
FSHLWTSG

SEQ ID NO: 253 - protein, 106 aa
FWVTPASLQSQFWVTLICSSTRPIRGSKLWLRRGRGSCIPLRSLWTPLVSTHRLMSTTCRWRLRCLRRLVTTPQWYMLCASTTLVALWFPQMGFPWGTASVGRRAC

SEQ ID NO: 254 - protein, 29 aa
QLARRTASLVTLRSARPAGGWGLRHHHSL

SEQ ID NO: 255 - protein, 5 aa
LEMIA

SEQ ID NO: 256 - protein, 46 aa
SSMKMMELIPALLLRLPWPTMDTGVNQQSMLHWTQLSVARPTWLSA

SEQ ID NO: 257 - protein, 8 aa
LGVPSAGG

SEQ ID NO: 258 - protein, 18 aa
GSRSQGRLPNIRTQSAVL

SEQ ID NO: 259 - protein, 11 aa
CIPGIQSCGMF

SEQ ID NO: 260 - protein, 4 aa
YHTY

SEQ ID NO: 261 - protein, 61 aa
WLTGVAAHRMSWLCVRFREIITLSRCGCCLASWSLYMVRGAYKSPRTVRRLGWRQAQXCGI

SEQ ID NO: 262 - protein, 14 aa
PGTADVPEMCALAS

SEQ ID NO: 263 - protein, 18 aa
GEARSGGTWPEPSSGXQX

SEQ ID NO: 264 - protein, 6 aa
RSXPXP

SEQ ID NO: 265 - protein, 18 aa
IHFQVFSWRRLTNTMKRS

SEQ ID NO: 266 - protein, 9 aa
SRSRVDHLG

SEQ ID NO: 267 - protein, 27 aa
GGFLVLVSRCWPPCCEFAPGSRTFGSG

SEQ ID NO: 268 - protein, 33 aa
VGVRGPGPPTEVGGKGPWTGRVEGPEPVHLPQG

SEQ ID NO: 269 - protein, 24 aa
GRGTSIGPVGPKGVWMPSVRVRRW

SEQ ID NO: 270 - protein, 10 aa
IPARRESAIG

SEQ ID NO: 271 - protein, 27 aa
AYPGDRCPGTSPAXLWTRSTGWGYRCE

SEQ ID NO: 272 - protein, 4 aa
SVSR

SEQ ID NO: 273 - protein, 5 aa
TETVS

SEQ ID NO: 274 - protein, 74 aa
DRNDAPRTGTPPKPSGQLCGLTIPVGGRGPADYLSCEFLLRLAERQPRGHQGGAALHAARGKILRVTPGGNPFP

SEQ ID NO: 275 - protein, 88 aa
EHECGRHIHHGLAVVAGLLPPRGGGALQLAAPVLQWGPLCAFQLLFPRRGLLLFRGRMSGGLWLYCLHTVLLEALPAWGGYSARVRTR

SEQ ID NO: 276 - protein, 25 aa
AAGEIWECNWSGVGFGLHRWSPRVG

SEQ ID NO: 277 - protein, 27 aa
TLQFGLLGDVPHQSPLTDSQRHLREGL

SEQ ID NO: 278 - protein, 10 aa
VYLPRLVHRF

SEQ ID NO: 279 - protein, 83 aa
LGVYQDLAVAGQAVARPNGXXGLEPPRDPHAGPRAAPPDSLPTAFGSGRGSEGDVRQLRVWLLGGQEAPVGDPAVPWQRYCGV

SEQ ID NO: 280 - protein, 20 aa
FWKNALGPPLVFRXGVAGRS

SEQ ID NO: 281 - protein, 60 aa
EGHRARPPPGLPPGGSRHGDSHVSVGFCLLDLEIWGLGCIVRRATTISSLYFLLRSWSTT

SEQ ID NO: 282 - protein, 17 aa
RSLSLESIRGTLCFLRR

SEQ ID NO: 283 - protein, 22 aa
PEAAEMWFLRPRLLGDGGSWVR

SEQ ID NO: 284 - protein, 16 aa
VRCRYSDDEAPRGRPG

SEQ ID NO: 285 - protein, 12 aa
WRCGVQGDNAQG

SEQ ID NO: 286 - protein, 18 aa
APQIHRSARCGNLLRRCP

SEQ ID NO: 287 - protein, 8 aa
PQHQLPSD

SEQ ID NO: 288 - protein, 25 aa
GGGLLACAEVPVRLCAPSAPRKNSR

SEQ ID NO: 289 - protein, 50 aa
ACECMSSWEVSAPVRKLGSRWVLRPRVHQVQLAEDLRSGCVSWVCFRFPW

SEQ ID NO: 290 - protein, 7 aa
SQRLHPC

SEQ ID NO: 291 - protein, 20 aa
RQQTAGLQWSAKVFAGLVAY

SEQ ID NO: 292 - protein, 12 aa
HGPGPVGGDEVG

SEQ ID NO: 293 - protein, 32 aa
SCPPVYAGNVVVVEWSICCHYCHHTPYCHEVH

SEQ ID NO: 294 - protein, 49 aa
KCSIVDSAHCSNSILPEFYHRSRGLYLQCWLLHGGRPGGRGSGGLGCCQ

SEQ ID NO: 295 - protein, 113 aa
WCSGRRWWHLARVAQAAKLRCRSGLVVKCWGLLAGRRGRXGSRAGVHPGGRLGSPGVVVHWLSGCDVCRGVPECPGLCXGCRACGDALRKGCSAAGIGGSCRGXPGAAQRLRA

SEQ ID NO: 296 - protein, 104 aa
GVLRSGWWRLAXRQLVLGFSRRGELGPPGGGSDDPRWPISQXDLVXQVGRQLXEGSXVGEQLTGWSXWXLXAXLESXVXXGLVLPPDSCHSXRHLHTLFEQFRC

SEQ ID NO: 297 - protein, 8 aa
FHLGXTLG

SEQ ID NO: 298 - protein, 17 aa
LTKSRALGAXAGLLSSX

SEQ ID NO: 299 - protein, 26 aa
GAAGLLLAGGRPAQAGRPPLRARXSH

SEQ ID NO: 300 - protein, 17 aa
QARCCPLARVGXCAXAX

SEQ ID NO: 301 - protein, 161 aa
XNQGRLXXCSGLCSCVGLWTIGPWETSGREARRRGVDRLCEQSVRPSAWLCSHCSRGXSSXXQXXXXGCEDXHDRQGPVRTPRXRGGPXDFNNXFHGLLRERSSVHXIPWXQRPXXGGAXWXXQXSVVVXEXRRHGXPAPXWXFLPXXXXVPTNWGVGDPE

SEQ ID NO: 302 - protein, 18 aa
RSSLPWNSRQGGGFRYAR

SEQ ID NO: 303 - protein, 15 aa
VVRLSRVFWITNLVR

SEQ ID NO: 304 - protein, 12 aa
GSCCWHADFGAS

SEQ ID NO: 305 - protein, 17 aa
GFLGAVYQTLGNSPSGD

SEQ ID NO: 306 - protein, 33 aa
GSIGGPPCARNHWIQGGATVPAHRSWQVDARAE

SEQ ID NO: 307 - protein, 39 aa
VRQGWTQXACTKPIHCHSEGHGPLHGKVNRQTSVGVLWP

SEQ ID NO: 308 - protein, 8 aa
HYCIFQDY

SEQ ID NO: 309 - protein, 71 aa
LIFDLLYIRQVYGQSQEILAGERRRNLRRVARHRPDLNFGDGSGEVTRSRVRRTPPAFRYGDPTGLSDGEA

SEQ ID NO: 310 - protein, 5 aa
GDVGQ

SEQ ID NO: 311 - protein, 13 aa
GGGPLLLPIPPTE

SEQ ID NO: 312 - protein, 17 aa
VCYWETPAVLSFQGRXH

SEQ ID NO: 313 - protein, 21 aa
VILSFGQLWCQHRCVLQRQRN

SEQ ID NO: 314 - protein, 4 aa
HSNW

SEQ ID NO: 315 - protein, 17 aa
RVRLRHRRTFHWLHWQF

SEQ ID NO: 316 - protein, 9 aa
HRNRLWFNG

SEQ ID NO: 317 - protein, 30 aa
GGSGSDPGPDHHYRCEDRPGPCRTEGSEAW

SEQ ID NO: 318 - protein, 31 aa
VWPWESGHLLSGIDVFGAGGNXSVWGSLGSC

SEQ ID NO: 319 - protein, 17 aa
GWXLVVWPRARCYWRPA

SEQ ID NO: 320 - protein, 55 aa
GLRLVSLYCCHQCVHRRGHCLFYWXSANEELSSGGLGQAEGXQLATLGGCAEAHV

SEQ ID NO: 321 - protein, 8 aa
GRGLWSXR

SEQ ID NO: 322 - protein, 21 aa
WSRMERHQGKRACSPVVPMGW

SEQ ID NO: 323 - protein, 8 aa
VGGSASLG

SEQ ID NO: 324 - protein, 51 aa
PTGPARCGRGLHSLHCWTGAFGRFGDGGGGYPGTLDGVSGCSDQLGCQWER

SEQ ID NO: 325 - protein, 7 aa
PADTKRL

SEQ ID NO: 326 - protein, 15 aa
GRGXXRSIPSTPRWW

SEQ ID NO: 327 - protein, 10 aa
TVPIRHQANX

SEQ ID NO: 328 - protein, 5 aa
GCDHP

SEQ ID NO: 329 - protein, 18 aa
DCVRXGPSRGXSGLCEGL

SEQ ID NO: 330 - protein, 6 aa
NWNHVG

SEQ ID NO: 331 - protein, 38 aa
QXECCVAGLGCKQLCASTSITLNFLVXELGXCVHFSLG

SEQ ID NO: 332 - protein, 78 aa
RVHSRPFLACWVHSCLRRSAEPTAGRRSLFLAGHVIEPXXSRQTCCCVAPRRRGYRPRHACYWACYGGCLLRXGQRYR

SEQ ID NO: 333 - protein, 70 aa
LAEYHCGSNRRLGGGXXRSLTHLRXPGXEVTSXXXLVPXQXXGLSGGFGGXCGXXXXAXVCQXGCGXXXG

SEQ ID NO: 334 - protein, 13 aa
QXVDDDATQFGDA

SEQ ID NO: 335 - protein, 6 aa
RFLPQR

SEQ ID NO: 336 - protein, 41 aa
VRHQGVYCPAKVVIVKMDHDSCGQAGDGDGDXRFSDCLGLA

SEQ ID NO: 337 - protein, 11 aa
LVHPAXSVPVQ

SEQ ID NO: 338 - protein, 6 aa
TXVCSP

SEQ ID NO: 339 - protein, 34 aa
VAPAAYRLQYRLGWPVGGQWSFGNKVYLWLCDYR

SEQ ID NO: 340 - protein, 32 aa
YSRWYIARPTLYLPTVQTLLQEDSACWRHGQC

SEQ ID NO: 341 - protein, 20 aa
GSSPPCAYWRWNQDLPNWDF

SEQ ID NO: 342 - protein, 16 aa
GCGRAWDNHGARHQLL

SEQ ID NO: 343 - protein, 4 aa
VESC

SEQ ID NO: 344 - protein, 47 aa
RSEGGASRPDLRWWRTLQLERAVYCACARLQARPGHQNRWSAPTVAL

SEQ ID NO: 345 - protein, 16 aa
LSTGSAPPPGIWQCCR

SEQ ID NO: 346 - protein, 4 aa
WLDR

SEQ ID NO: 347 - protein, 51 aa
GREGLGGNQGCRHRGHWGGLAPPFTGGCSGRSRGFGGGCRVPVAPCARHYG

SEQ ID NO: 348 - protein, 5 aa
LFMPG

SEQ ID NO: 349 - protein, 17 aa
GVPRPLHPRTQCDRGTH

SEQ ID NO: 350 - protein, 31 aa
AHGRRRGGTQAAGCRPDRQVARLGGHGSRPR

SEQ ID NO: 351 - protein, 30 aa
VNRGCSRSFDAFAHRGGLNAIIGVEPLLLL

SEQ ID NO: 352 - protein, 5 aa
TNLFN

SEQ ID NO: 353 - protein, 33 aa
DCRRGWLTLGVRELQHRAVSGSEDCQNPTGLLL

SEQ ID NO: 354 - protein, 22 aa
QIHNEGHAVVVHCRGVPLRYSL

SEQ ID NO: 355 - protein, 7 aa
PGRSPTV

SEQ ID NO: 356 - protein, 12 aa
RARSDRGIYSYM

SEQ ID NO: 357 - protein, 9 aa
SDWGHQASV

SEQ ID NO: 358 - protein, 35 aa
GNSNILLLHLVRGALGYWEKCPPTHDAPYRDPSDL

SEQ ID NO: 359 - protein, 7 aa
HYQSLCY

SEQ ID NO: 360 - protein, 10 aa
AGREGYNLEG

SEQ ID NO: 361 - protein, 21 aa
GCPEKGSRDEVSWLDLFPGYS

SEQ ID NO: 362 - protein, 53 aa
APSSRWIRQQGDRLHIGHWLASRGGDAGQNSQGTGSSFHFCDQARGFLLQNYP

SEQ ID NO: 363 - protein, 15 aa
APKIHSFPTFGLQDS

SEQ ID NO: 364 - protein, 5 aa
KDDSG

SEQ ID NO: 365 - protein, 10 aa
PRHRCKVNSG

SEQ ID NO: 366 - protein, 16 aa
RLSVPVHAQSEGQSSG

SEQ ID NO: 367 - protein, 21 aa
GVGGEVASRCDHCGRHLFRLI

SEQ ID NO: 368 - protein, 13 aa
ARHAGGGFGVCGG

SEQ ID NO: 369 - protein, 30 aa
QPLNGTCFVQVLLWWPYGFPRWGSLGVPPV

SEQ ID NO: 370 - protein, 7 aa
VVGRVNN

SEQ ID NO: 371 - protein, 9 aa
LGEQHHLLH

SEQ ID NO: 372 - protein, 10 aa
GQRGLQAGGD

SEQ ID NO: 373 - protein, 9 aa
GTIILYSWR

SEQ ID NO: 374 - protein, 5 aa
LLDHL

SEQ ID NO: 375 - protein, 5 aa
SLPCS

SEQ ID NO: 376 - protein, 10 aa
GCPGQLWIQV

SEQ ID NO: 377 - protein, 10 aa
TNKACFTGHS

SEQ ID NO: 378 - protein, 7 aa
VLLGLLG

SEQ ID NO: 379 - protein, 66 aa
VRSWGCQALVVEHGHEEAARKGVFRIFGPNRQCFRDHLDVSPASNRAVCSNTTRTNNGLQEWQHTG

SEQ ID NO: 380 - protein, 39 aa
VGYVSGSGKSLLFPAAAAASRLGLSTWSVVPTSHHGQYE

SEQ ID NO: 381 - protein, 71 aa
DGGRLSXAGFRNEIPSLAPPTCRKCAHSPPEGRQGVGAPGQSPPLAXRXEGAXPXHKFTSRFSAGDALRTP

SEQ ID NO: 382 - protein, 41 aa
RGLDLDQESTTLDKVDSWCLSLVAGRLAVNSLQAVGPSGRG

SEQ ID NO: 383 - protein, 67 aa
WESGAPDLPPRWGERGPGPAGWKARNRSIFLKVEEGVRLSVRSVRKASGCLVLGFVGGKSQLGVKAL

SEQ ID NO: 384 - protein, 64 aa
DRLIPVTAAPEPAPRXFGHGPQVGGTGVNNPPTEASVVKRRRSPEIATTPHVRERRQNLRDSYA

SEQ ID NO: 385 - protein, 18 aa
QSQWGAGDQLITCPASSS

SEQ ID NO: 386 - protein, 25 aa
DWPKGSHGATKAAQRCMRQGEKSFG

SEQ ID NO: 387 - protein, 2972 aa
PLVAIPSLRSMSVVDTFTMAWLWLLVCFPLAGGVLFNSRHQCFNGDHYVLSNCCSRDEVYFCFGDGCLVAYGCTVCTQSCWKLYRPGVATRPGSEPGELLGRFGSVIGPVSASAYTAGVLGLGEPYSLAFLGTFLTSRLSRIPNVTCVKACDLEFTYPGLSIDFDWAFTKILQLPAKLWRGLTXXPVLSLLVILMLVLEQRLLIAFLLLLVVGEAQRGMFDNCVCGYWGGKRPPSVTPLYRGNGTVVCDCDFGKMHWAPPLCSXLVWRDGHRRGTVRDLPPVCPREVLGTVTVMCQWGSAYWIWRFGDWVALYDELPRSALCTFFSGHGPQPKDLSVLNPSGAPCASCVVDQRPLKCGSCVRDCWETGGPGFDECGVGTRMTKHLEAVLVDGGVESKVTTPKGERPKYIGQHGVGTYYGAVRSLNISYLVTEVGGYWHALKCPCDFVPRVLPERIPGRPVNACLAGKSPHPFASWAPGGFYAPVFTKCNWPKTSGVDVCPGFAFDFPGDHNGFIHVKGNRQQVYSGQRRSSPAWLLTDMVLALLVVMKLAEARVVPLFMLAMWWWLNGASAATIVIIHPTVTKSTESVPLWTPPTVPTPSCPNSTTGVADSTYNAGCYMVAGLAAGAQAVWGAANDGAQAVVGGIWPAWLKLRSFAAGLAWLSNVGAYLPVVEAXLAPELVCTPVVGWAAQEWWFTGCLGVMCVVAYLNVLGSXRAAVLVAMHFARGALPLVLVVAAGXTRERHSVLGLEVCFDLDGGDWXDASWSWGLAGVVSWALLVGGLMTHGGRSARXTWXARWAVNXQRVXRWVNNSPVGXFXRWXXAWKXWXXVAWFFPQTVATXSVIFILCLSSLDVIDFILXVLLVNSPNLARLAXVLDSLAXAEERLACSWLVGVLRKRGVLLYEHXGHTSRRGAARLREWXFAXEXVXITKEDXXIVRDSARVLGCGQLVHGKPVVARRGDEVLIGCVNSRFDLPPGFVPTAPVXLHXXGXXXXGVVKXSMTGKDPSEHHXNVVVXGTSTXRSMGCCVNGVVYXTYHXTNAXXMAGXFXXVXARWWXAXDDVTXYPLXNXASCXXXXKCQPTGVWVIRNDGALCHGTLGKVVDLDMPAELSDFRGSSGSPILCDEGHAVGMLISVLHRGSRVSSVRYTKPWETLPREIEARSEAPPVPGTTGYREAPLFLPTGAGKSTRVPNEYVKAGHXVLVLNPSIATVRAMGPYMEKLTGKHPSVYCGHDTTAYSRTTDSSLTYCTYGRFMANPRKYLRGNDVVICDELHVTDPTSILGMGRARLLARECGVRLLLFATATPPVSPMAKHESIHEEMLGSEGEVPFYCQFLPLSRYATGRHLLFCHSKVXCTRLSSALASFGVNTVVYFRGKETDIPTGDVCVCATDALSTGYTGNFDTVTDCGLMVEEVVEVTLDPTITIGVKTVPAPAELRAQRRGRCGRGKAGTYYQALMSSAPAGXVRSGALWAAVEAXVSWYGLEPDAIGDLLRAYDSCPYTAAISASIGEAIAFFTXLVPMRNYPQVVWAKQKXHNWPLLVGVQRHMCEDAGCGXPANGPEWSGIRGKGPVPLLCRWGGDLPESVAPHHWVDDLQARLGVAEGYTPCIAGPVLLVGLAMAGGAILAHWTGSLVVVTSWVVNGNGNPLIQSASRGVXXSGPYPVPPDGGERYPSDIKPXTEAVTTLETACXWGPAAXSLAYVKACETGTMLADXASAAWQAWAANNFVPPPASHSTSLXQSLXAAFTSAWDSVFTHGRSLLVGFTAAYGARRNPPLGVGASFLLGMSSSHXTHVRLAAALLLGVGGTVLGTPATGLAMAGAYFXGGSVTANWLSIIVALIGGWEGXXNAASLTFXLLXGKLQXXXAWCXVXCXASPGASVXGVXXXXXXWSVXKGVXXXWVNRXLTMMPRSSVMPDDFFLKDEFVTKVSTVLRKLSLSRWIMTLVDKREMEMEXPASQIVWDLLDWCIRXGRFLYNKXMFALPRLRLPLIGCSTGWGGPWEGNGHLETRCTCGCVITGDIHDGILHDLHYTSLLCRHYYKRTVPVGVMGNAEGAVPLVPTGGGIRTYQIGTSDWFEAVVVHGTITVHATSCYELKAADVRRAVRAGPTYVGGVPCSWSAPCTAPALVYRLGQGIKIDGARRLLPCDLAQGARHPPVSGSVAGSGWTDEDERDLVETKAAAIEAIGAALHLPSPEAAQAALEALEEAAVSLLPHVPVIMGDDCSCRDEAFQGHFIPEPNVTEVPIEPTVGDVEALKLRAADLTARLQDLEAMALARAESIEDARAASMPSLTEVDSMPSLESSPCSSFEQISLTESDPETVVEAGLPLEFVNSNTGPSPARRIVRIRQACCCDRSTMKAMPLSFTVGECLFVTRYDPDGHQLFDERGPIEVSTPICEVIGDIRLQCDQIEETPTSYSYIWSGAPLGTGRSVPQPMTRPIGTHLTCDTTKVYVTDPDRAAERAEKVTIWRGDRKYDKHYEAVVEAVLKKAAATKSHGWTYSQAIAKVRRRAAAGYGSKVTASTLATGWPHVEEMLDKIARGQEVPFTFVTKREVFFSKTTRKPPRFIVFPPLDFRIAEKMILGDPGIVAKSILGDAYLFQYTPNQRVKALVKAWEGKLHPAAITVDATCFDSSIDEHDMQVEASVFAAASDNPSMVHALCKYYSGGPMVSPDGVPLGYRQCRSSGVLTTSSANSITCYIKVSAACRRVGIKAPSFFIAGDDCLIIYENDGTDPCPALKAALANYGYRCEPTKHASLDTAECCSAYLAECVAGGAKRWWLSTDMRKPLARASSEYSDPIGSALGTILMYPRHPIVRYVLIPHVLIMAYRSGSTPDELVMCQVQGNHYSFPLRLLPRVLVSLHGPWCLQVTTDSTKTRMEAGSXLRDLGMKSLAWHRRRAGNVRTRLLRGGKEWGHLARALLWXPXLKEXPXPINSLPGFQLATPYEHHEEVLISIKSRPPWIRWILGACLSLLAALL

SEQ ID NO: 388 - protein, 5 aa
IRSRQ

SEQ ID NO: 389 - protein, 5 aa
DLRVG

SEQ ID NO: 390 - DNA (genomic), 9143 bp; double-stranded, linear
accacaaacactccagtttgttacactccgctaggaatgctcctggagcaccccccctagcagggcgtgggggatttcccctgcccgtctgcagaagggtggagccaaccaccttagtatgtaggcggcgggactcatgacgctcgcgtgatgacaagcgccaagcttgacttggatggccctgatgggcgttcatgggttcggtggtggtggcgctttaggcagcctccacgcccaccacctcccagatagagcggcggcactgtagggaagaccggggaccggtcactaccaaggacgcagacctctttttgagtatcacgcctccggaagtagttgggcaagcccacctatatgtgttgggatggttggggttagccatccataccgtactgcctgatagggtccttgcgaggggatctgggagtctcgtagaccgtagcacatgcctgttatttctactcaaacaagtcctgtacctgcgcccagaacgcgcaagaacaagcagacgcaggcttcatatcctgtgtccattaaaacatctgttgaaaggggacaacgagcaaagcgcaaagtccagcgcgatgctcggcctcgtaattacaaaattgctggtatccatgatggcttgcagacattggctcaggctgctttgccagctcatggttggggacgccaagaccctcgccataagtctcgcaatcttggaatccttctggattaccctttggggtggattggtgatgttacaactcacacacctctagtaggcccgctggtggcaggagcggtcgttcgaccagtctgccagatagtacgcttgctggaggatggagtcaactgggctactggttggttcggtgtccacctttttgtggtatgtctgctatctttggcctgtccctgtagtggggcgcgggtcactgacccagacacaaataccacaatcctgaccaattgctgccagcgtaatcaggttatctattgttctccttccacttgcctacacgagcctggttgtgtgatctgcgcggacgagtgctgggttcccgccaatccgtacatctcacacccttccaattggactggcacggactccttcttggctgaccacattgattttgttatgggcgctcttgtgacctgtgacgcccttgacattggtgagttgtgtggtgcgtgtgtattagtcggtgactggcttgtcaggcactggcttattcacatagacctcaatgaaactggtacttgttacctggaagtgcccactggaatagatcctgggttcctagggtttatcgggtggatggccggcaaggtcgaggctgtcatcttcttgaccaaactggcttcacaagtaccatacgctattgcgactatgtttagcagtgtacactacctggcggttggcgctctgatctactatgcctctcggggcaagtggtatcagttgctcctagcgcttatgctttacatagaagcgacctctggaaaccctatcagggtgcccactggatgctcaatagctgagttttgctcgcctttgatgataccatgtccttgccactcttatttgagtgagaatgtgtcagaagtcatttgttacagtccaaagtggaccaggcctgtcactctagagtataacaactccatatcttggtacccctatacaatccctggtgcgaggggatgtatggttaaattcaaaaataacacatggggttgctgccgtattcgcaatgtgccatcgtactgcactatgggcactgatgcagtgtggaacgacactcgcaacacttacgaagcatgcggtgtaacaccatggctaacaaccgcatggcacaacggctcagccctgaaattggctatattacaataccctgggtctaaagaaatgtttaaacctcataattggatgtcaggccatttgtattttgagggatcagatacccctatagtttacttttatgaccctgtgaattccactctcctaccaccggagaggtgggctaggttgcccggtaccccacctgtggtacgtggttcttggttacaggttccgcaagggttttacagtgatgtgaaagacctagccacaggattgatcaccaaagacaaagcctggaaaaattatcaggtcttatattccgccacgggtgctttgtctcttacgggagttaccaccaaggccgtggtgctaattctgttggggttgtgtggcagcaagtatcttattttagcctacctctgttacttgtccctttgttttgggcgcgcttctggttaccctttgcgtcctgtgctcccatcccagtcgtatctccaagctggctgggatgttttgtctaaagctcaagtagctccttttgctttgattttcttcatctgttgctatctccgctgcaggctacgttatgctgcccttttagggtttgtgcccatggctgcgggcttgcccctaactttctttgttgcagcagctgctgcccaaccagattatgactggtgggtgcgactgctagtggcagggttagttttgtgggccggccgtgaccgtggtccacgtatagctctgcttgtaggtccttggcctctggtagcgcttttaaccctcttgcatttggctacgcctgcttcagcttttgacaccgagataattggagggctgacaataccacctgtagtagcattagttgtcatgtctcgttttggcttctttgctcacttgttacctcgctgtgctttagttaactcctatctttggcaacgttgggagaattggttttggaacgttacactaagaccggagaggtttctccttgtgctggtttgtttccccggtgcgacatatgacacgctggtgactttctgtgtgtgtcacgtagctcttctatgtttaacatccagtgcagcatcgttctttgggactgactctagggttagggcccatagaatgttggtgcgtctcggaaagtgtcatgcttggtattctcattatgttcttaagtttttcctcttagtgtttggtgagaatggtgtgtttttctataagcacttgcatggtgatgtcttgcctaatgattttgcctcgaaactaccattgcaagagccatttttcccttttgaaggcaaggcaagggtctataggaatgaaggaagacgcttggcgtgtggggacacggttgatggtttgcccgttgttgcgcgtctcggcgaccttgttttcgcagggttagctatgccgccagatgggtgggccattaccgcaccttttacgctgcagtgtctctctgaacgtggcacgctgtcagcgatggcagtggtcatgactggtatagacccccgaacttggactggaactatcttcagattaggatctctggccactagctacatgggatttgtttgtgacaacgtgttgtatactgctcaccatggcagcaaggggcgccggttggctcatcccacaggctccatacacccaataaccgttgacgcggctaatgaccaggacatctatcaaccaccatgtggagctgggtcccttactcggtgctcttgcggggagaccaaggggtatctggtaacacgactggggtcattggttgaggtcaacaaatccgatgacccttattggtgtgtgtgcggggcccttcccatggctgttgccaagggttcttcaggtgccccgattctgtgctcctccgggcatgttattgggatgttcaccgctgctagaaattctggcggttcagtcagccagattagggttaggccgttggtgtgtgctggataccatccccagtacacagcacatgccactcttgatacaaaacctactgtgcctaacgagtattcagtgcaaattttaattgcccccactggcagcggcaagtcaaccaaattaccactttcttacatgcaggagaagtatgaggtcttggtcctaaatcccagtgtggctacaacagcatcaatgccaaagtacatgcacgcgacgtacggcgtgaatccaaattgctattttaatggcaaatgtaccaacacaggggcttcacttacgtacagcacatatggcatgtacctgaccggagcatgttcccggaactatgacgtcatcatttgtgacgaatgccatgctaccgatgcaaccaccgtgttgggcattggaaaggttctaaccgaagctccatccaaaaatgttaggctagtggttcttgccacggctaccccccctggagtaatccctacaccacatgccaacataactgagattcaattaaccgatgaaggcactatcccctttcatggaaaaaagattaaggaggaaaatctgaagaaagggagacaccttatctttgaggctaccaaaaaacactgtgatgagcttgctaacgagttagctcgaaagggaataacagctgtctcttactataggggatgtgacatctcaaaaatccctgagggcgactgtgtagtagttgccactgatgccttgtgtacagggtacactggtgactttgattccgtgtatgactgcagcctcatggtagaaggcacatgccatgttgaccttgaccctactttcaccatgggtgttcgtgtgtgcggggtctcagcaatagttaaaggccagcgtaggggccgcacaggccgtgggagagctggcatatactactatgtagacgggagttgtaccccttcgggtatggttcctgaatgcaacattgttgaagccttcgacgcagccaaggcatggtatggtttgtcatcaacagaagctcaaactattctggacacctatcgcacccaacctgggttacctgcgataggagcaaatttggacgagtgggctgatctcttttctatggtcaaccccgaaccttcatttgtcaatactgcaaaaagaactgctgacaattatgttttgttgactgcagcccaactacaactgtgtcatcagtatggctatgctgctcccaatgacgcaccacggtggcagggagcccggcttgggaaaaaaccttgtggggttctgtggcgcttggacggcgctgacgcctgtcctggcccagagcccagcgaggtgaccagataccaaatgtgcttcactgaagtcaatacttctgggacagccgcactcgctgttggcgttggagtggctatggcttatctagccattgacacttttggcgccacttgtgtgcggcgttgctggtctattacatcagtccctaccggtgctactgtcgccccagtggttgacgaagaagaaatcgtggaggagtgtgcatcattcattcccttggaggccatggttgctgcaatcgataagctgaagagtacaataaccacaactagtcctttcacattggaaaccgcccttgaaaaacttaacacctttcttgggcctcatgcagctacaatccttgctatcatagagtattgctgtggcttagtcactttacctgacaatccctttgcatcatgcgtgtttgctttcattgcgggtattactaccccactacctcacaagatcaaaatgttcctgtcattatttggaggcgcaattgcgtccaagcttacagacgctagaggcgcactggcgttcatgatggccggggctgcgggaacagctcttggtacatggacatcggtgggttttgtctttgacatgctaggcggctatgctgccgcctcatccactgcttgcttgacatttaaatgcttgatgggtgagtggcccactatggatcagcttgctggtttagtctactccgcgttcaatccggccgcaggagttgtgggcgtcttgtcagcttgtgcaatgtttgctttgacaacagcagggccagatcactggcccaacagacttcttactatgcttgctaggagcaacactgtatgtaatgagtactttattgccactcgtgacatccgcaggaagatactgggcattctggaggcatctaccccctggagtgtcatatcagcttgcatccgttggctccacaccccgacggaggatgattgcggcctcattgcttggggtctagagatttggcagtatgtgtgcaatttctttgtgatttgctttaatgtccttaaagctggagttcagagcatggttaacattcctggttgtcctttctacagctgccagaaggggtacaagggcccctggattggatcaggtatgctccaagcacgctgtccatgcggtgctgaactcatcttttctgttgagaatggttttgcaaaactttacaaaggacccagaacttgttcaaattactggagaggggctgttccagtcaacgctaggctgtgtgggtcggctagaccggacccaactgattggactagtcttgtcgtcaattatggcgttagggactactgtaaatatgagaaattgggagatcacatttttgttacagcagtatcctctccaaatgtctgtttcacccaggtgcccccaaccttgagagctgcagtggccgtggacggcgtacaggttcagtgttatctaggtgagcccaaaactccttggacgacatctgcttgctgttacggtccggacggtaagggtaaaactgttaagcttcccttccgcgttgacggtcacacacctggtgtgcgcatgcaacttaatttgcgtgatgcacttgagacaaatgactgtaattccataaacaacactcctagtgatgaagccgcagtgtccgctcttgttttcaaacaggagttgcggcgtacaaaccaattgcttgaggcaatttcagctggcgttgacaccaccaaactgccagccccctccatcgaagaggtagtggtaagaaagcgccagttccgggcaagaactggttcgcttaccttgcctccccctccgagatccgtcccaggagtgtcatgtcctgaaagcctgcaacgaagtgacccgttagaaggtccttcaaacctcccttcttcaccacctgttctacagttggccatgccgatgcccctgttgggagcaggtgagtgtaaccctttcactgcaattggatgtgcaatgaccgaaacaggcggaggccctgatgatttacccagttaccctcccaaaaaggaggtctctgaatggtcagacggaagttggtcaacgactacaaccgcttccagctacgttactggccccccgtaccctaagatacggggaaaggattccactcagtcagcccccgccaaacggcctacaaaaaagaagttgggaaagagtgagttttcgtgcagcatgagctacacttggaccgacgtgattagcttcaaaactgcttctaaagttctgtctgcaactcgggccatcactagtggtttcctcaaacaaagatcattggtgtatgtgactgagccgcgggatgcggagcttagaaaacaaaaagtcactattaatagacaacctctgttccccccatcataccacaagcaagtgagattggctaaggaaaaagcttcaaaagttgtcggtgtcatgtgggactatgatgaagtagcagctcacacgccctctaagtctgctaagtcccacatcactggccttcggggcactgatgttcgttctggagcagcccgcaaggctgttctggacttgcagaagtgtgtcgaggcaggtgagataccgagtcattatcggcaaactgtgatagttccaaaggaggaggtcttcgtgaagaccccccagaaaccaacaaagaaacccccaaggcttatctcgtacccccaccttgaaatgagatgtgttgagaagatgtactacggtcaggttgctcctgacgtagttaaagctgtcatgggagatgcgtacgggtttgtcgacccacgtacccgtgtcaagcgtctgttgtcgatgtggtcacccgatgcagtcggagccacatgcgatacagtgtgttttgacagtaccatcacacccgaggatatcatggtggagacagacatctactcagcagctaaactcagtgaccaacaccgagctggcattcacaccattgcgaggcagttatacgctggaggaccgatgatcgcttatgatggccgagagatcggatatcgtaggtgtaggtcttccggcgtctatactacctcaagttccaacagtttgacctgctggctgaaggtaaatgctgcagccgaacaggctggcatgaagaaccctcgcttccttatttgcggcgatgattgcaccgtaatttggaagagcgccggagcagatgcagacaaacaagcaatgcgtgtctttgctagctggatgaaggtgatgggtgcaccacaagattgtgtgcctcaacccaaatacagtttggaagaattaacatcatgctcatcaaatgttacctctggaattaccaaaagtggcaagccttactactttcttacaagagatcctcgtatcccccttggcaggtgctctgccgagggtctgggatacaaccccagtgctgcgtggattgggtatctaatacatcactacccatgtttgtgggttagccgtgtgttggctgtccatttcatggagcagatgctctttgaggacaaacttcccgagactgtgacctttgactggtatgggaaaaattatacggtgcctgtagaagatctgcccagcatcattgctggtgtgcacggtattgaggctttctcggtggtgcgctacaccaacgctgagatcctcagagtttcccaatcactaacagacatgaccatgccccccctgcgagcctggcgaaagaaagccagggcggtcctcgccagcgccaagaggcgtggcggagcacacgcaaaattggctcgcttccttctctggcatgctacatctagacctctaccagatttggataagacgagcgtggctcggtacaccactttcaattattgtgatgtttactccccggagggggatgtgtttgttacaccacagagaagattgcagaagtttcttgtgaagtatttggctgtcattgtttttgccctagggctcattgctgttggactagccatcagctgaacccccaaattcaaaattaattaacagtttttttttttttttttttttttttttagggcagcggcaacaggggagaccccgggcttaacgaccccgcgatgtg

SEQ ID NO: 391 - DNA (genomic), 234 bp; single-stranded, linear; identical to SEQ ID NO: 30

SEQ ID NO: 392 - DNA (genomic), 479 bp; single-stranded, linear; identical to SEQ ID NO: 25

SEQ ID NO: 393 - DNA (genomic), 9143 bp; double-stranded, linear; identical to SEQ ID NO: 390
  5'UTR 1..445
  CDS 446..9037
  3'UTR 9038..9143

SEQ ID NO: 394 - protein, 2864 aa
MPVISTQTSPVPAPRTRKNKQTQASYPVSIKTSVERGQRAKRKVQRDARPRNYKIAGIHDGLQTLAQAALPAHGWGRQDPRHKSRNLGILLDYPLGWIGDVTTHTPLVGPLVAGAVVRPVCQIVRLLEDGVNWATGWFGVHLFVVCLLSLACPCSGARVTDPDTNTTILTNCCQRNQVIYCSPSTCLHEPGCVICADECWVPANPYISHPSNWTGTDSFLADHIDFVMGALVTCDALDIGELCGACVLVGDWLVRHWLIHIDLNETGTCYLEVPTGIDPGFLGFIGWMAGKVEAVIFLTKLASQVPYAIATMFSSVHYLAVGALIYYASRGKWYQLLLALMLYIEATSGNPIRVPTGCSIAEFCSPLMIPCPCHSYLSENVSEVICYSPKWTRPVTLEYNNSISWYPYTIPGARGCMVKFKNNTWGCCRIRNVPSYCTMGTDAVWNDTRNTYEACGVTPWLTTAWHNGSALKLAILQYPGSKEMFKPHNWMSGHLYFEGSDTPIVYFYDPVNSTLLPPERWARLPGTPPVVRGSWLQVPQGFYSDVKDLATGLITKDKAWKNYQVLYSATGALSLTGVTTKAVVLILLGLCGSKYLILAYLCYLSLCFGRASGYPLRPVLPSQSYLQAGWDVLSKAQVAPFALIFFICCYLRCRLRYAALLGFVPMAAGLPLTFFVAAAAAQPDYDWWVRLLVAGLVLWAGRDRGPRIALLVGPWPLVALLTLLHLATPASAFDTEIIGGLTIPPVVALVVMSRFGFFAHLLPRCALVNSYLWQRWENWFWNVTLRPERFLLVLVCFPGATYDTLVTFCVCHVALLCLTSSAASFFGTDSRVRAHRMLVRLGKCHAWYSHYVLKFFLLVFGENGVFFYKHLHGDVLPNDFASKLPLQEPFFPFEGKARVYRNEGRRLACGDTVDGLPVVARLGDLVFAGLAMPPDGWAITAPFTLQCLSERGTLSAMAVVMTGIDPRTWTGTIFRLGSLATSYMGFVCDNVLYTAHHGSKGRRLAHPTGSIHPITVDAANDQDIYQPPCGAGSLTRCSCGETKGYLVTRLGSLVEVNKSDDPYWCVCGALPMAVAKGSSGAPILCSSGHVIGMFTAARNSGGSVSQIRVRPLVCAGYHPQYTAHATLDTKPTVPNEYSVQILIAPTGSGKSTKLPLSYMQEKYEVLVLNPSVATTASMPKYMHATYGVNPNCYFNGKCTNTGASLTYSTYGMYLTGACSRNYDVIICDECHATDATTVLGIGKVLTEAPSKNVRLVVLATATPPGVIPTPHANITEIQLTDEGTIPFHGKKIKEENLKKGRHLIFEATKKHCDELANELARKGITAVSYYRGCDISKIPEGDCVVVATDALCTGYTGDFDSVYDCSLMVEGTCHVDLDPTFTMGVRVCGVSAIVKGQRRGRTGRGRAGIYYYVDGSCTPSGMVPECNIVEAFDAAKAWYGLSSTEAQTILDTYRTQPGLPAIGANLDEWADLFSMVNPEPSFVNTAKRTADNYVLLTAAQLQLCHQYGYAAPNDAPRWQGARLGKKPCGVLWRLDGADACPGPEPSEVTRYQMCFTEVNTSGTAALAVGVGVAMAYLAIDTFGATCVRRCWSITSVPTGATVAPVVDEEEIVEECASFIPLEAMVAAIDKLKSTITTTSPFTLETALEKLNTFLGPHAATILAIIEYCCGLVTLPDNPFASCVFAFIAGITTPLPHKIKMFLSLFGGAIASKLTDARGALAFMMAGAAGTALGTWTSVGFVFDMLGGYAAASSTACLTFKCLMGEWPTMDQLAGLVYSAFNPAAGVVGVLSACAMFALTTAGPDHWPNRLLTMLARSNTVCNEYFIATRDIRRKILGILEASTPWSVISACIRWLHTPTEDDCGLIAWGLEIWQYVCNFFVICFNVLKAGVQSMVNIPGCPFYSCQKGYKGPWIGSGMLQARCPCGAELIFSVENGFAKLYKGPRTCSNYWRGAVPVNARLCGSARPDPTDWTSLVVNYGVRDYCKYEKLGDHIFVTAVSSPNVCFTQVPPTLRAAVAVDGVQVQCYLGEPKTPWTTSACCYGPDGKGKTVKLPFRVDGHTPGVRMQLNLRDALETNDCNSINNTPSDEAAVSALVFKQELRRTNQLLEAISAGVDTTKLPAPSIEEVVVRKRQFRARTGSLTLPPPPRSVPGVSCPESLQRSDPLEGPSNLPSSPPVLQLAMPMPLLGAGECNPFTAIGCAMTETGGGPDDLPSYPPKKEVSEWSDGSWSTTTTASSYVTGPPYPKIRGKDSTQSAPAKRPTKKKLGKSEFSCSMSYTWTDVISFKTASKVLSATRAITSGFLKQRSLVYVTEPRDAELRKQKVTINRQPLFPPSYHKQVRLAKEKASKVVGVMWDYDEVAAHTPSKSAKSHITGLRGTDVRSGAARKAVLDLQKCVEAGEIPSHYRQTVIVPKEEVFVKTPQKPTKKPPRLISYPHLEMRCVEKMYYGQVAPDVVKAVMGDAYGFVDPRTRVKRLLSMWSPDAVGATCDTVCFDSTITPEDIMVETDIYSAAKLSDQHRAGIHTIARQLYAGGPMIAYDGREIGYRRCRSSGVYTTSSSNSLTCWLKVNAAAEQAGMKNPRFLICGDDCTVIWKSAGADADKQAMRVFASWMKVMGAPQDCVPQPKYSLEELTSCSSNVTSGITKSGKPYYFLTRDPRIPLGRCSAEGLGYNPSAAWIGYLIHHYPCLWVSRVLAVHFMEQMLFEDKLPETVTFDWYGKNYTVPVEDLPSIIAGVHGIEAFSVVRYTNAEILRVSQSLTDMTMPPLRAWRKKARAVLASAKRRGGAHAKLARFLLWHATSRPLPDLDKTSVARYTTFNYCDVYSPEGDVFVTPQRRLQKFLVKYLAVIVFALGLIAVGLAIS

SEQ ID NO: 395 - protein, 200 aa
KFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPG

SEQ ID NO: 396 - protein, 100 aa
CCDLDPQARVAIKSLTERLYVGGPLTNSRGENCGYRRCRASGVLTTSCGNTLTCYIKARAACRAAGLQDCTMLVCGDDLVVICESAGVQEDAASLRAFTE

SEQ ID NO: 397 - DNA (genomic), 9034 bp; double-stranded, linear
  CDS 1..9034
aaaggtggtggatgggtgatgacagggttggtaggtcgtaaatcccggtcatcctggtagccactataggtgggtcttaaggggaggctacggtccctcttgcgcatatggaggaaaagcgcacggtccacaggtgttggtcctaccggtgtaataaggacccggcgctaggcacgccgttaaaccgagcccgttactcccctgggcaaacgacgcccacgtacggtccacgtcgcccttcaatgtctctcttgaccaataggcgtacggcgagttgacaaggaccagtgggggccgggcgggagggggaaggacccccaccgctgcccttcccggggaggcgggaaatgcatggggccacccagctccgcggcggcctacagccggggtagcccaagaacttcgggtgagggcgggtggcatttcttttcctataccgatcatggcagtccttctgctcctactcgtggtggagccggggctattttagccccggccacccatgcttgtagcgcgaaagggcaatatttsctcacaaactgttgcgccctggaggacataggcttctgcctggagggcggatgcctggtggctctggggtgcaccatttgcaccgaccgctgctggccactgtatcaggcgggtttggccgtgcggcccggcaagtccgccgcccagttggtgggggaactcggtagtctctacgggcccttgtcggtctcggcttatgtggccgggatcctggggcttggggaggtctactcgggggtcctcaccgtcggggtggcgttgacgcgcagggtctacccggtcccgaacctgacgtgtgcagtagagtgtgagttgaagtgggaaagtgagttttggagatggactgaacagctggcctcaaactactggattctggaatacctctggaaggtgcctttcgacttttggcggggagtgatgagccttactcctctcttggtgtgcgtggcggccctcctcctgctggagcagcgtattgtcatggtcttcctcctggtcactatggcgggcatgtcgcaaggcgcgcccgcctcaagtgttggggtcacggcctttcgaggcgggtttgacttggcagtcttgttcttgcaggtcgaacgggtcccgcgtgccgacagggagagggtttgggaacgtgggaacgtcacacttttgtgtgactgccccaacggtccttgggtgtgggtcccggccctttgccaggcaatcggatggggcgaccctatcactcattggagccacggacaaaatcagtggcccctttcttgtccccaatttgtctacggcgccgtttcagtgacctgcgtgtggggttctgtgtcttggtttgcttccactgggggtcgcgactccaaggttgatgtgtggagtttggttccagttggctctgccagctgcaccatagccgcactgggatcttcggatcgcgacacagtggttgagctctccgagtggggaattccctgcgccacttgtatcctggacaggcggcctgcctcgtgtggcacctgtgtgagggactgctggcccgagaccgggtcggtacgtttcccattccacaggtgtggcgcgggaccgaggctgaccagagaccttgaggctgtgcccttcgtcaataggacaactcccttcaccataagggggcccctgggcaaccaggggcgaggcaacccggtgcggtcgcccttgggttttgggtcctacaccatgaccaagatccgagactccttacacttggtgaaatgtcccaccccagccattgagcctcccaccggaacgtttgggttcttcccaggagtccccccccttaacaactgcatgcttctcggcactgaggtgtcagaggtattgggtggggcgggcctcactggggggttttacgaacctctggtgcggcggtgttcagagctgatgggtcggcggaatccggtctgcccggggtttgcatggctctcttcgggacggcctgatgggttcatacatgttcagggccacttgcaggaggtggatgcgggcaacttcattccgcccccacgctggttgctcttggactttgtatttgtcctgttatacctgatgaagctggcagaggcacggttggtcccgctgatcctcctcctgctatggtggtgggtgaaccagttggcggtccttgktgtgscggctgckcrcgccgccgtggctggagaggtgtttgcgggccctgccttgtcctggtgtctgggcctacccttcgtgagtatgatcctggggctagcaaacctggtgttgtacttccgctggatgggtcctcaacgcctgatgttcctcgtgttgtggaagctcgctcggggggctttcccgctggcattactgatggggatttccgccactcgcggccgcacctctgtgcttggcgccgaattctgctttgatgtcacctttgaagtggacacgtcagtcttgggttgggtggttgctagtgtggtggcttgggccatagcgctcctgagctctatgagcgcgggggggtggaagcacaaagccataatctataggacgtggtgtaaagggtaccaggcycttcgccagcgcgtggtgcgtagccccctcggggaggggcggcccaccaagccgctgacgatagcctggtgtctggcctcttacatctggccggacgctgtgatgttggtggttgtggccatggtcctcctcttcggccttttcgacgcgctcgattgggccttggaggagctccttgtgtcgcggccttcgttgcgtcgtttggcaagggtggtggagtgttgtgtgatggcgggcgagaaggccactaccgtccggcttgtgtccaagatgtgcgcgagaggggcctacctgtttgaccacatggggtcgttctcgcgcgcggtcaaggagcgcttgctggagtgggacgcggctttggagmccctgtcattcactaggacggactgtcgcatcatacgagacgccgccaggaccctgagctgcggccaatgcgtcatgggcttgcccgtggtggctaggcgcggcgatgaggtcctgattggggtctttcaggatgtgaaccacttgcctccggggtttgytcctacagcgcctgttgtcatccgtcggtgcggaaagggcttcctcggggtcactaaggctgccttgactggtcgggatcctgacttacacccaggaaacgtcatggttttggggacggctacctcgcgcagcatgggaacgtgcttaaacgggttgctgttcacgacattccatggggcttcttcccgaaccattgcgacacctgtgggggcccttaacccaaggtggtggtcggccagtgatgacgtcacggtctatcccctccccgatggagctaactcgttggttccctgctcgtgtcaggctgagtcctgttgggtcatycgatccgatggggctctttgccatggcttgagcaagggggacaaggtagaactggacgtggccatggaggttgctgactttcgtgggtcgtctgggtctcctgtcctatgcgacgaggggcacgctgtaggaatgctcgtgtccgtccttcattcgggggggagggtgaccgcggctcgattcactcggccgtggacccaagtcccaacagacgccaagactaccactgagccacccccggtgccagctaaaggggttttcaaagaggctcctcttttcatgccaacaggggcggggaaaagcacacgcgtccctttggagtatggaaacatggggcacaaggtcctgattctcaacccgtcggttgccactgtgagggccatgggcccttacatggagaggctggcggggaaacatcctagcattttctgtggacacgacacaacagctttcacacggatcacggactctccattgacgtactctacctatgggaggtttctggccaacccgaggcagatgctgaggggagtttccgtggtcatctgtgatgagtgccacagtcatgactcaactgtgttgctgggtataggcagggtcagggacgtggcgcgggggtgtggagtgcaattagtgctctacgctactgcgactcccccgggctcgcctatgactcagcatccatccataattgagacaaagctggacgttggtgagatccccttttatgggcatggtatccccctcgagcgtatgaggactggtcgccaccttgtattctgccattccaaggcggagtgcgagagattggccggccagttctccgcgcggggggttaatgccatcgcctattataggggtaaggacagttccatcatcaaagacggagacctggtggtttgtgcgacagacgcgctctctaccgggtacacaggaaacttcgattctgtcaccgactgtgggttggtggtggaggaggtcgttgaggtgacccttgatcccaccattaccatttccttgcggactgtccctgcttcggctgaattgtcgatgcagcggcgcggacgcacggggagaggtcggtcgggccgctactactacgctggggtcggtaaggctcccgcgggggtggtgcggtctggtccggtctggtcggcagtggaagctggagtgacctggtatggaatggaacctgacttgacagcaaaccttctgagactttacgacgactgcccttacaccgcagccgtcgcagctgacattggtgaagccgcggtgttctttgcgggcctcgcgcccctcaggatgcatcccgatgttagctgggcaaaagttcgcggcgtcaattggcccctcctggtgggtgttcagcggacgatgtgtcgggaaacactgtctcccggcccgtcggacgaccctcagtgggcaggtctgaaaggcccgaatcctgtcccactactgctgaggtggggcaatgatttgccatcaaaagtggccggccaccacatagttgacgatctggtccgtcggctcggtgtggcggagggatacgtgcgctgtgatgctggrcccatcctcatggtgggcttggccatagcgggcggcatgatctacgcctcttacactgggtcgctagtggtggtaacagactgggatgtgaagggaggtggcaatcccctttataggagtggtgaccaggccacccctcaacccgtggtgcaggtccccccggtagaccatcggccggggggggagtctgcgccacgggatgccaagacagtgacagatgcggtggcagccatccaggtgaactgcgattggtctgtgatgaccctgtcgatcggggaagtcctcaccttggctcaggctaagacagccgaggcctacgcagctacttccaggtggctcgctggctgctacacggggacgcgggccgtccccactgtatcaattgttgacaagctcttcgccgggggttgggccgccgtggtgggtcactgtcacagcgtcattgctgcggcggtggctgcctatggagcttctcgaagtcctccactggccgcggcggcgtcctacctcatggggttgggcgtcggaggcaacgcacaggcgcgcttggcttcagctcttctactgggggctgctggtacggctctggggacccctgtcgtgggactcaccatggcgggggccttcatgggcggtgccagcgtgtccccctccctcgtcactgtcctacttggggctgtgggaggttgggagggcgttgtcaacgctgccagtctcgtcttcgacttcatggctgggaaactttcaacagaagacctttggtatgccatcccggtactcactagtcctggrgcgggcctcgcggggattgcccttggtctggttttgtactcagcaaacaactctggcactaccacatggctgaaccgtctgctgacgacgttgccacggtcatcttgcatacccgacagctacttccaacaggctgactactgcgacaaggtctcggcaatcgtgcgccgcctgagccttactcgcaccgtggtggccctggtcaacagggagcctaaggtggatgaggtccaggtggggtacgtctgggatctgtgggagtgggtgatgcgccaggtgcgcatggtgatgtctagactccgggccctctgccctgtggtgtcactccccttgtggcactgcggggaggggtggtccggtgaatggcttctcgatgggcacgtggagagtcgttgtctgtgcgggtgtgtaatcaccggcgacgtcctcaatgggcaactcaaagatccagtttactctaccaagctgtgcaggcactactggatgggaactgtgccggtcaacatgctgggctacggggaaacctcacctcttctcgcctctgacaccccgaaggtggtacccttcgggacgtcggggtgggctgaggtggtggtgacccctacccacgtggtgatcaggcgcacgtcctgttacaaactgcttcgccagcaaattctttcagcagctgtagctgagccctactacgttgatggcattccggtctcttgggaggctgacgcgagagcgccggccatggtctacggtccgggccaaagtgttaccattgatggggagcgctacacccttccgcaccagttgcggatgcggaatgtggcgccctctgaggtttcatctgaggtcagcatcgagatcgggacggagactgaagactcagaactgactgaggccgatttgccaccagcggctgctgccctccaagcgatagagaatgctgcgagaattctcgaaccgcacatcgatgtcaycatggaggattgcagtacaccctctctctgtggtagtagccgagagatgcctgtgtggggagaagacataccccgcactccatcgcctgcacttatctcggttacggagagcagctcagatgagaagaccctgtcggtgacctcctcgcaggaggacaccccgtcctcagactcatttgaagtcatccaagagtctgatactgctgaatcagaggaaagcgtcttcaacgtggctctttccgtactaaaagccttatttccacagagcgatgccacacgaaagctaacggttaagatgtcttgctgtgttgagaagagcgtaacacgcttcttttctttagggttgaccgtggctgacgtggctagcctgtgtgagatggagatccagaaccatacagcctattgtgacaaggtgcgcactccgctcgaattgcaagttgggtgcttggtgggcaatgaacttacctttgaatgtgacaagtgtgaggcacgccaagagacccttgcctccttctcctacatatggtccggggtcccacttactcgggccactccggccaaaccaccagtggtgaggccggtggggtccttgttggtggcagacaccaccaaggtctacgtgaccaatccggacaatgttgggaggagggttgacaaggtgactttctggcgcgctcctcgggtacacgacaagttcctcgtggactcgatcgagcgcgctcggagagctgctcaaggctgcctaagcatgggttacacttatgaggaggcaataaggactgttaggccgcatgctgccatgggctggggatctaaggtgtcggtcaaggacttggccacccctgcggggaagatggctgttcatgaccggcttcaggagatacttgaagggactccggtcccttttaccctgactgtcaaaaaggaggtgttcttcaaagatcgtaaggaggagaaggccccccgcctcattgtgttcccccccctggacttccggatagctgaaaagctcattctgggagacccggggcgggttgcaaaggccggtgttgggggggcttacgccttccagtacacccccaaccagcgggttaaggagatgctaaagctgtgggaatcaaagaagaccccgtgcgccatctgtgtggatgccacttgcttcgacagtagcattactgargaggacgtggcactagagacagagctttacgccctggcctcggaccatccagaatgggtgcgcgccctggggaaatactrtgcctctggcacaatggtgaccccggaaggggtgccagtgggcgagaggtattgtaggtcctcgggtgtgttgaccacaagtgctagcaactgtttgacctgctacatcaaagtgagagccgcctgtgagaggatcggactgaaaaatgtctcgcttctcatcgcgggcgatgactgcttaattgtgtgcgagaggcctgtatgcgacccttgcgaggccctgggccgaaccctggcttcgtacgggtacgcgtgtgagccctcgtatcacgcttcactggacacagcccccttctgctccacttggctcgctgagtgcaatgcggatgggraaaggcatttcttcctgaccacggactttcggagaccactcgctcgcatgtcgagcgagtacagtgaccctatggcttcggccattggttacattctcctctacccctggcrtcccatcacacggtgggtcatcatcccgcatgtgctaacatgcgcttcttcccggggtggtggcacacsgtctgatccggtttggtgtcaggttcatggtaactactacaagtttcccctggacaaactgcctaacatcatcgtggccctccacggaccagcagcgttgagggttaccgcagacacaaccaaaacaaagatggaggctgggaaggttctgagcgacctcaagctccctggtctagccgtccaccgcaagaaggccggggcattgcgaacacgcatgctccggtcgcgcggttgggcggagttggctaggggcctgttgtggcatccaggactccggcttcctccccctgagattgctggtatcccagggggtttccctctgtcccccccctacatgggggtggttcatcaattggatttcacagcscagcggagtcgctggcggtggttggggttcttagccctgctcatcgtagcgctctttgggtgaactaaattcatctgttgcggccggagtcagacctgagccccgttcaaaaggggattgagac

SEQ ID NO: 398 - protein, 19 aa
KGGGWVMTGLVGRKSRSSW

SEQ ID NO: 399 - protein, 33 aa
VGLKGRLRSLLRIWRKSARSTGVGPTGVIRTRR

SEQ ID NO: 400 - protein, 23 aa
TEPVTPLGKRRPRTVHVALQCLS

SEQ ID NO: 401 - protein, 2905 aa
PIGVRRVDKDQWGPGGRGKDPHRCPSRGGGKCMGPPSSAAAYSRGSPRTSGEGGWHFFSYTDHGSPSAPTRGGAGAILAPATHACSAKGQYXLTNCCALEDIGFCLEGGCLVALGCTICTDRCWPLYQAGLAVRPGKSAAQLVGELGSLYGPLSVSAYVAGILGLGEVYSGVLTVGVALTRRVYPVPNLTCAVECELKWESEFWRWTEQLASNYWILEYLWKVPFDFWRGVMSLTPLLVCVAALLLLEQRIVMVFLLVTMAGMSQGAPASSVGVTAFRGGFDLAVLFLQVERVPRADRERVWERGNVTLLCDCPNGPWVWVPALCQAIGWGDPITHWSHGQNQWPLSCPQFVYGAVSVTCVWGSVSWFASTGGRDSKVDVWSLVPVGSASCTIAALGSSDRDTVVELSEWGIPCATCILDRRPASCGTCVRDCWPETGSVRFPFHRCGAGPRLTRDLEAVPFVNRTTPFTIRGPLGNQGRGNPVRSPLGFGSYTMTKIRDSLHLVKCPTPAIEPPTGTFGFFPGVPPLNNCMLLGTEVSEVLGGAGLTGGFYEPLVRRCSELMGRRNPVCPGFAWLSSGRPDGFIHVQGHLQEVDAGNFIPPPRWLLLDFVFVLLYLMKLAEARLVPLILLLLWWWVNQLAVLXVXAXXAAVAGEVFAGPALSWCLGLPFVSMILGLANLVLYFRWMGPQRLMFLVLWKLARGAFPLALLMGISATRGRTSVLGAEFCFDVTFEVDTSVLGWVVASVVAWAIALLSSMSAGGWKHKAIIYRTWCKGYQXLRQRVVRSPLGEGRPTKPLTIAWCLASYIWPDAVMLVVVAMVLLFGLFDALDWALEELLVSRPSLRRLARVVECCVMAGEKATTVRLVSKMCARGAYLFDHMGSFSRAVKERLLEWDAALEXLSFTRTDCRIIRDAARTLSCGQCVMGLPVVARRGDEVLIGVFQDVNHLPPGFXPTAPVVIRRCGKGFLGVTKAALTGRDPDLHPGNVMVLGTATSRSMGTCLNGLLFTTFHGASSRTIATPVGALNPRWWSASDDVTVYPLPDGANSLVPCSCQAESCWVXRSDGALCHGLSKGDKVELDVAMEVADFRGSSGSPVLCDEGHAVGMLVSVLHSGGRVTAARFTRPWTQVPTDAKTTTEPPPVPAKGVFKEAPLFMPTGAGKSTRVPLEYGNMGHKVLILNPSVATVRAMGPYMERLAGKHPSIFCGHDTTAFTRITDSPLTYSTYGRFLANPRQMLRGVSVVICDECHSHDSTVLLGIGRVRDVARGCGVQLVLYATATPPGSPMTQHPSIIETKLDVGEIPFYGHGIPLERMRTGRHLVFCHSKAECERLAGQFSARGVNAIAYYRGKDSSIIKDGDLVVCATDALSTGYTGNFDSVTDCGLVVEEVVEVTLDPTITISLRTVPASAELSMQRRGRTGRGRSGRYYYAGVGKAPAGVVRSGPVWSAVEAGVTWYGMEPDLTANLLRLYDDCPYTAAVAADIGEAAVFFAGLAPLRMHPDVSWAKVRGVNWPLLVGVQRTMCRETLSPGPSDDPQWAGLKGPNPVPLLLRWGNDLPSKVAGHHIVDDLVRRLGVAEGYVRCDAXPILMVGLAIAGGMIYASYTGSLVVVTDWDVKGGGNPLYRSGDQATPQPVVQVPPVDHRPGGESAPRDAKTVTDAVAAIQVNCDWSVMTLSIGEVLTLAQAKTAEAYAATSRWLAGCYTGTRAVPTVSIVDKLFAGGWAAVVGHCHSVIAAAVAAYGASRSPPLAAAASYLMGLGVGGNAQARLASALLLGAAGTALGTPVVGLTMAGAFMGGASVSPSLVTVLLGAVGGWEGVVNAASLVFDFMAGKLSTEDLWYAIPVLTSPXAGLAGIALGLVLYSANNSGTTTWLNRLLTTLPRSSCIPDSYFQQADYCDKVSAIVRRLSLTRTVVALVNREPKVDEVQVGYVWDLWEWVMRQVRMVMSRLRALCPVVSLPLWHCGEGWSGEWLLDGHVESRCLCGCVITGDVLNGQLKDPVYSTKLCRHYWMGTVPVNMLGYGETSPLLASDTPKVVPFGTSGWAEVVVTPTHVVIRRTSCYKLLRQQILSAAVAEPYYVDGIPVSWEADARAPAMVYGPGQSVTIDGERYTLPHQLRMRNVAPSEVSSEVSIEIGTETEDSELTEADLPPAAAALQAIENAARILEPHIDVXMEDCSTPSLCGSSREMPVWGEDIPRTPSPALISVTESSSDEKTLSVTSSQEDTPSSDSFEVIQESDTAESEESVFNVALSVLKALFPQSDATRKLTVKMSCCVEKSVTRFFSLGLTVADVASLCEMEIQNHTAYCDKVRTPLELQVGCLVGNELTFECDKCEARQETLASFSYIWSGVPLTRATPAKPPVVRPVGSLLVADTTKVYVTNPDNVGRRVDKVTFWRAPRVHDKFLVDSIERARRAAQGCLSMGYTYEEAIRTVRPHAAMGWGSKVSVKDLATPAGKMAVHDRLQEILEGTPVPFTLTVKKEVFFKDRKEEKAPRLIVFPPLDFRIAEKLILGDPGRVAKAGVGGAYAFQYTPNQRVKEMLKLWESKKTPCAICVDATCFDSSITXEDVALETELYALASDHPEWVRALGKYXASGTMVTPEGVPVGERYCRSSGVLTTSASNCLTCYIKVRAACERIGLKNVSLLIAGDDCLIVCERPVCDPCEALGRTLASYGYACEPSYHASLDTAPFCSTWLAECNADGXRHFFLTTDFRRPLARMSSEYSDPMASAIGYILLYPWXPITRWVIIPHVLTCASSRGGGTXSDPVWCQVHGNYYKFPLDKLPNIIVALHGPAALRVTADTTKTKMEAGKVLSDLKLPGLAVHRKKAGALRTRMLRSRGWAELARGLLWHPGLRLPPPEIAGIPGGFPLSPPYMGVVHQLDFTXQRSRWRWLGFLALLIVALFG

SEQ ID NO: 402 - protein, 11 aa
TKFICCGRSQT

SEQ ID NO: 403 - protein, 8 aa
APFKRGLR

SEQ ID NO: 404 - protein, 5 aa
KVVDG

SEQ ID NO: 405 - protein, 39 aa
VVNPGHPGSHYRWVLRGGYGPSCAYGGKAHGPQVLVLPV

SEQ ID NO: 406 - protein, 34 aa
GPGARHAVKPSPLLPWANDAHVRSTSPFNVSLDQ

SEQ ID NO: 407 - protein, 75 aa
AYGELTRTSGGRAGGGRTPTAALPGEAGNAWGHPAPRRPTAGVAQELRVRAGGISFPIPIMAVLLLLLVVEPGLF

SEQ ID NO: 408 - protein, 23 aa
PRPPMLVARKGNIXSQTVAPWRT

SEQ ID NO: 409 - protein, 76 aa
ASAWRADAWWLWGAPFAPTAAGHCIRRVWPCGPASPPPSWWGNSVVSTGPCRSRLMWPGSWGLGRSTRGSSPSGWR

SEQ ID NO: 410 - protein, 9 aa
RAGSTRSRT

SEQ ID NO: 411 - protein, 33 aa
SGKVSFGDGLNSWPQTTGFWNTSGRCLSTFGGE

SEQ ID NO: 412 - protein, 125 aa
ALLLSWCAWRPSSCWSSVLSWSSSWSLWRACRKARPPQVLGSRPFEAGLTWQSCSCRSNGSRVPTGRGFGNVGTSHFCVTAPTVLGCGSRPFARQSDGATLSLIGATDKISGPFLVPNLSTAPFQ

SEQ ID NO: 413 - protein, 34 aa
PACGVLCLGLLPLGVATPRLMCGVWFQLALPAAP

SEQ ID NO: 414 - protein, 36 aa
PHWDLRIATQWLSSPSGEFPAPLVSWTGGLPRVAPV

SEQ ID NO: 415 - protein, 22 aa
GTAGPRPGRYVSHSTGVARDRG

SEQ ID NO: 416 - protein, 17 aa
PETLRLCPSSIGQLPSP

SEQ ID NO: 417 - protein, 23 aa
GGPWATRGEATRCGRPWVLGPTP

SEQ ID NO: 418 - protein, 9 aa
PRSETPYTW

SEQ ID NO: 419 - protein, 56 aa
NVPPQPLSLPPERLGSSQESPPLTTACFSALRCQRYWVGRASLGGFTNLWCGGVQS

SEQ ID NO: 420 - protein, 54 aa
WVGGIRSARGLHGSLRDGLMGSYMFRATCRRWMRATSFRPHAGCSWTLYLSCYT

SEQ ID NO: 421 - protein, 9 aa
SWQRHGWSR

SEQ ID NO: 422 - protein, 8 aa
SSSCYGGG

SEQ ID NO: 423 - protein, 33 aa
TSWRSLXXRLXXPPWLERCLRALPCPGVWAYPS

SEQ ID NO: 424 - protein, 14 aa
QTWCCTSAGWVLNA

SEQ ID NO: 425 - protein, 17 aa
CSSCCGSSLGGLSRWHY

SEQ ID NO: 426 - protein, 41 aa
WGFPPLAAAPLCLAPNSALMSPLKWTRQSWVGWLLVWWLGP

SEQ ID NO: 427 - protein, 9 aa
ARGGGSTKP

SEQ ID NO: 428 - protein, 29 aa
SIGRGVKGTRXFASAWCVAPSGRGGPPSR

SEQ ID NO: 429 - protein, 12 aa
PGVWPLTSGRTL

SEQ ID NO: 430 - protein, 41 aa
CWWLWPWSSSSAFSTRSIGPWRSSLCRGLRCVVWQGWWSVV

SEQ ID NO: 431 - protein, 63 aa
WRARRPLPSGLCPRCAREGPTCLTTWGRSRARSRSACWSGTRLWXPCHSLGRTVASYETPPGP

SEQ ID NO: 432 - protein, 19 aa
AAANASWACPWWLGAAMRS

SEQ ID NO: 433 - protein, 6 aa
LGSFRM

SEQ ID NO: 434 - protein, 29 aa
TTCLRGLXLQRLLSSVGAERASSGSLRLP

SEQ ID NO: 435 - protein, 26 aa
LVGILTYTQETSWFWGRLPRAAWERA

SEQ ID NO: 436 - protein, 68 aa
TGCCSRHSMGLLPEPLRHLWGPLTQGGGRPVMTSRSIPSPMELTRWFPARVRLSPVGSXDPMGLFAMA

SEQ ID NO: 437 - protein, 5 aa
ARGTR

SEQ ID NO: 438 - protein, 26 aa
NWTWPWRLLTFVGRLGLLSYATRGTL

SEQ ID NO: 439 - protein, 12 aa
ECSCPSFIRGGG

SEQ ID NO: 440 - protein, 59 aa
PRLDSLGRGPKSQQTPRLPLSHPRCQLKGFSKRLLFSCQQGRGKAHASLWSMETWGTRS

SEQ ID NO: 441 - protein, 8 aa
FSTRRLPL

SEQ ID NO: 442 - protein, 33 aa
GPWALTWRGWRGNILAFSVDTTQQLSHGSRTLH

SEQ ID NO: 443 - protein, 15 aa
RTLPMGGFWPTRGRC

SEQ ID NO: 444 - protein, 21 aa
GEFPWSSVMSATVMTQLCCWV

SEQ ID NO: 445 - protein, 13 aa
AGSGTWRGGVECN

SEQ ID NO: 446 - protein, 12 aa
CSTLLRLPRARL

SEQ ID NO: 447 - protein, 5 aa
LSIHP

SEQ ID NO: 448 - protein, 21 aa
LRQSWTLVRSPFMGMVSPSSV

SEQ ID NO: 449 - protein, 77 aa
GLVATLYSAIPRRSARDWPASSPRGGLMPSPIIGVRTVPSSKTETWWFVRQTRSLPGTQETSILSPTVGWWWRRSLR

SEQ ID NO: 450 - protein, 60 aa
PLIPPLPFPCGLSLLRLNCRCSGADARGEVGRAATTTLGSVRLPRGWCGLVRSGRQWKLE

SEQ ID NO: 451 - protein, 8 aa
PGMEWNLT

SEQ ID NO: 452 - protein, 4 aa
QQTF

SEQ ID NO: 453 - protein, 72 aa
DFTTTALTPQPSQLTLVKPRCSLRASRPSGCIPMLAGQKFAASIGPSWWVFSGRCVGKHCLPARRTTLSGQV

SEQ ID NO: 454 - protein, 9 aa
KARILSHYC

SEQ ID NO: 455 - protein, 14 aa
GGAMICHQKWPATT

SEQ ID NO: 456 - protein, 28 aa
LTIWSVGSVWRRDTCAVMLXPSSWWAWP

SEQ ID NO: 457 - protein, 8 aa
STPLTLGR

SEQ ID NO: 458 - protein, 4 aa
QTGM

SEQ ID NO: 459 - protein, 24 aa
REVAIPFIGVVTRPPLNPWCRSPR

SEQ ID NO: 460 - protein, 15 aa
TIGRGGSLRHGMPRQ

SEQ ID NO: 461 - protein, 8 aa
QMRWQPSR

SEQ ID NO: 462 - protein, 5 aa
TAIGL

SEQ ID NO: 463 - protein, 200 aa
PCRSGKSSPWLRLRQPRPTQLLPGGSLAATRGRGPSPLYQLLTSSSPGVGPPWWVTVTASLLRRWLPMELLEVLHWPRRRPTSWGWASEATHRRAWLQLFYWGLLVRLWGPLSWDSPWRGPSWAVPACPPPSSLSYLGLWEVGRALSTLPVSSSTSWLGNFQQKTFGMPSRYSLVLXRASRGLPLVWFCTQQTTLALPHG

SEQ ID NO: 464 - protein, 29 aa
RRCHGHLAYPTATSNRLTTATRSRQSCAA

SEQ ID NO: 465 - protein, 30 aa
ALLAPWWPWSTGSLRWMRSRWGTSGICGSG

SEQ ID NO: 466 - protein, 6 aa
CARCAW

SEQ ID NO: 467 - protein, 40 aa
CLDSGPSALWCHSPCGTAGRGGPVNGFSMGTWRVVVCAGV

SEQ ID NO: 468 - protein, 61 aa
SPATSSMGNSKIQFTLPSCAGTTGWELCRSTCWATGKPHLFSPLTPRRWYPSGRRGGLRWW

SEQ ID NO: 469 - protein, 5 aa
PLPTW

SEQ ID NO: 470 - protein, 18 aa
SGARPVTNCFASKFFQQL

SEQ ID NO: 471 - protein, 69 aa
LSPTTLMAFRSLGRLTRERRPWSTVRAKVLPLMGSATPFRTSCGCGMWRPLRFHLRSASRSGRRLKTQN

SEQ ID NO: 472 - protein, 14 aa
LRPICHQRLLPSKR

SEQ ID NO: 473 - protein, 59 aa
RMLREFSNRTSMSXWRIAVHPLSVVVAERCLCGEKTYPALHRLHLSRLRRAAQMRRPCR

SEQ ID NO: 474 - protein, 35 aa
PPRRRTPRPQTHLKSSKSLILLNQRKASSTWLFPY

SEQ ID NO: 475 - protein, 12 aa
KPYFHRAMPHES

SEQ ID NO: 476 - protein, 11 aa
RLRCLAVLRRA

SEQ ID NO: 477 - protein, 5 aa
HASFL

SEQ ID NO: 478 - protein, 75 aa
PWLTWLACVRWRSRTIQPIVTRCALRSNCKLGAWWAMNLPLNVTSVRHAKRPLPPSPTYGPGSHLLGPLRPNHQW

SEQ ID NO: 479 - protein, 15 aa
GRWGPCWWQTPPRST

SEQ ID NO: 480 - protein, 12 aa
PIRTMLGGGLTR

SEQ ID NO: 481 - protein, 27 aa
LSGALLGYTTSSSWTRSSALGELLKAA

SEQ ID NO: 482 - protein, 9 aa
AWVTLMRRQ

SEQ ID NO: 483 - protein, 45 aa
GLLGRMLPWAGDLRCRSRTWPPLRGRWLFMTGFRRYLKGLRSLLP

SEQ ID NO: 484 - protein, 28 aa
LSKRRCSSKIVRRRRPPASLCSPPWTSG

SEQ ID NO: 485 - protein, 34 aa
LKSSFWETRGGLQRPVLGGLTPSSTPPTSGLRRC

SEQ ID NO: 486 - protein, 29 aa
SCGNQRRPRAPSVWMPLASTVALLXRTWH

SEQ ID NO: 487 - protein, 27 aa
RQSFTPWPRTIQNGCAPWGNTXPLAQW

SEQ ID NO: 488 - protein, 17 aa
PRKGCQWARGIVGPRVC

SEQ ID NO: 489 - protein, 7 aa
PQVLATV

SEQ ID NO: 490 - protein, 5 aa
PATSK

SEQ ID NO: 491 - protein, 8 aa
EPPVRGSD

SEQ ID NO: 492 - protein, 12 aa
KMSRFSSRAMTA

SEQ ID NO: 493 - protein, 55 aa
LCARGLYATLARPWAEPWLRTGTRVSPRITLHWTQPPSAPLGSLSAMRMXKGISS

SEQ ID NO: 494 - protein, 43 aa
PRTFGDHSLACRASTVTLWLRPLVTFSSTPGXPSHGGSSSRMC

SEQ ID NO: 495 - protein, 43 aa
HALLPGVVAHXLIRFGVRFMVTTTSFPWTNCLTSSWPSTDQQR

SEQ ID NO: 496 - protein, 16 aa
GLPQTQPKQRWRLGRF

SEQ ID NO: 497 - protein, 7 aa
ATSSSLV

SEQ ID NO: 498 - protein, 74 aa
PSTARRPGHCEHACSGRAVGRSWLGACCGIQDSGFLPLRLLVSQGVSLCPPPTWGWFINWISQXSGVAGGGWGS

SEQ ID NO: 499 - protein, 4 aa
PCSS

SEQ ID NO: 500 - protein, 23 aa
RSLGELNSSVAAGVRPEPRSKGD

SEQ ID NO: 501 - protein, 12 aa
RWWMGDDRVGRS

SEQ ID NO: 502 - protein, 12 aa
IPVILVATIGGS

SEQ ID NO: 503 - protein, 65 aa
GEATVPLAHMEEKRTVHRCWSYRCNKDPALGTPLNRARYSPGQTTPTYGPRRPSMSLLTNRRTAS

SEQ ID NO: 504 - protein, 37 aa
QGPVGAGREGEGPPPLPFPGRREMHGATQLRGGLQPG

SEQ ID NO: 505 - protein, 5 aa
PKNFG

SEQ ID NO: 506 - protein, 33 aa
GRVAFLFLYRSWQSFCSYSWWSRGYFSPGHPCL

SEQ ID NO: 507 - protein, 61 aa
RERAIFXHKLLRPGGHRLLPGGRMPGGSGVHHLHRPLLATVSGGFGRAARQVRRPVGGGTR

SEQ ID NO: 508 - protein, 47 aa
SLRALVGLGLCGRDPGAWGGLLGGPHRRGGVDAQGLPGPEPDVCSRV

SEQ ID NO: 509 - protein, 5 aa
VEVGK

SEQ ID NO: 510 - protein, 73 aa
TAGLKLLDSGIPLEGAFRLLAGSDEPYSSLGVRGGPPPAGAAYCHGLPPGHYGGHVARRARLKCWGHGLSRRV

SEQ ID NO: 511 - protein, 29 aa
LGSLVLAGRTGPACRQGEGLGTWERHTFV

SEQ ID NO: 512 - protein, 66 aa
LPQRSLGVGPGPLPGNRMGRPYHSLEPRTKSVAPFLSPICLRRRFSDLRVGFCVLVCFHWGSRLQG

SEQ ID NO: 513 - protein, 26 aa
CVEFGSSWLCQLHHSRTGIFGSRHSG

SEQ ID NO: 514 - protein, 51 aa
ALRVGNSLRHLYPGQAACLVWHLCEGLLARDRVGTFPIPQVWRGTEADQRP

SEQ ID NO: 515 - protein, 6 aa
GCALRQ

SEQ ID NO: 516 - protein, 47 aa
DNSLHHKGAPGQPGARQPGAVALGFWVLHHDQDPRLLTLGEMSHPSH

SEQ ID NO: 517 - protein, 15 aa
ASHRNVWVLPRSPPP

SEQ ID NO: 518 - protein, 7 aa
QLHASRH

SEQ ID NO: 519 - protein, 44 aa
GVRGIGWGGPHWGVLRTSGAAVFRADGSAESGLPGVCMALFGTA

SEQ ID NO: 520 - protein, 147 aa
WVHTCSGPLAGGGCGQLHSAPTLVALGLCICPVIPDEAGRGTVGPADPPPAMVVGEPVGGPXCXGCXRRRGWRGVCGPCLVLVSGPTLREYDPGASKPGVVLPLDGSSTPDVPRVVEARSGGFPAGITDGDFRHSRPHLCAWRRILL

SEQ ID NO: 521 - protein, 11 aa
SGHVSLGLGGC

SEQ ID NO: 522 - protein, 24 aa
CGGLGHSAPELYERGGVEAQSHNL

SEQ ID NO: 523 - protein, 11 aa
RVPGXSPARGA

SEQ ID NO: 524 - protein, 91 aa
PPRGGAAHQAADDSLVSGLLHLAGRCDVGGCGHGPPLRPFRRARLGLGGAPCVAAFVASFGKGGGVLCDGGREGHYRPACVQDVRERGLPV

SEQ ID NO: 525 - protein, 26 aa
PHGVVLARGQGALAGVGRGFGXPVIH

SEQ ID NO: 526 - protein, 26 aa
DGLSHHTRRRQDPELRPMRHGLARGG

SEQ ID NO: 527 - protein, 35 aa
GPDWGLSGCEPLASGVXSYSACCHPSVRKGLPRGH

SEQ ID NO: 528 - protein, 8 aa
GCLDWSGS

SEQ ID NO: 529 - protein, 44 aa
LTPRKRHGFGDGYLAQHGNVLKRVAVHDIPWGFFPNHCDTCGGP

SEQ ID NO: 530 - protein, 7 aa
PKVVVGQ

SEQ ID NO: 531 - protein, 10 aa
RHGLSPPRWS

SEQ ID NO: 532 - protein, 9 aa
LVGSLLVSG

SEQ ID NO: 533 - protein, 30 aa
VLLGHXIRWGSLPWLEQGGQGRTGRGHGGC

SEQ ID NO: 534 - protein, 50 aa
LSWVVWVSCPMRRGARCRNARVRPSFGGEGDRGSIHSAVDPSPNRRQDYH

SEQ ID NO: 535 - protein, 6 aa
ATPGAS

SEQ ID NO: 536 - protein, 56 aa
RGFQRGSSFHANRGGEKHTRPFGVWKHGAQGPDSQPVGCHCEGHGPLHGEAGGETS

SEQ ID NO: 537 - protein, 42 aa
HFLWTRHNSFHTDHGLSIDVLYLWEVSGQPEADAEGSFRGHL

SEQ ID NO: 538 - protein, 4 aa
VPQS

SEQ ID NO: 539 - protein, 41 aa
LNCVAGYRQGQGRGAGVWSAISALRYCDSPGLAYDSASIHN

SEQ ID NO: 540 - protein, 6 aa
DKAGRW

SEQ ID NO: 541 - protein, 40 aa
DPLLWAWYPPRAYEDWSPPCILPFQGGVREIGRPVLRAGG

SEQ ID NO: 542 - protein, 5 aa
CHRLL

SEQ ID NO: 543 - protein, 40 aa
GQFHHQRRRPGGLCDRRALYRVHRKLRFCHRLWVGGGGGR

SEQ ID NO: 544 - protein, 14 aa
SHHYHFLADCPCFG

SEQ ID NO: 545 - protein, 23 aa
IVDAAARTHGERSVGPLLLRWGR

SEQ ID NO: 546 - protein, 26 aa
GSRGGGAVWSGLVGSGSWSDLVWNGT

SEQ ID NO: 547 - protein, 20 aa
LDSKPSETLRRLPLHRSRRS

SEQ ID NO: 548 - protein, 17 aa
SRGVLCGPRAPQDASRC

SEQ ID NO: 549 - protein, 51 aa
LGKSSRRQLAPPGGCSADDVSGNTVSRPVGRPSVGRSERPESCPTTAEVGQ

SEQ ID NO: 550 - protein, 11 aa
FAIKSGRPPHS

SEQ ID NO: 551 - protein, 15 aa
RSGPSARCGGGIRAL

SEQ ID NO: 552 - protein, 40 aa
CWXHPHGGLGHSGRHDLRLLHWVASGGNRLGCEGRWQSPL

SEQ ID NO: 553 - protein, 58 aa
PGHPSTRGAGPPGRPSAGGGVCATGCQDSDRCGGSHPGELRLVCDDPVDRGSPHLGSG

SEQ ID NO: 554 - protein, 28 aa
DSRGLRSYFQVARWLLHGDAGRPHCINC

SEQ ID NO: 555 - protein, 131 aa
QALRRGLGRRGGSLSQRHCCGGGCLWSFSKSSTGRGGVLPHGVGRRRQRTGALGFSSSTGGCWYGSGDPCRGTHHGGGLHGRCQRVPLPRHCPTWGCGRLGGRCQRCQSRLRLHGWETFNRRPLVCHPGTH

SEQ ID NO: 556 - protein, 47 aa
SWXGPRGDCPWSGFVLSKQLWHYHMAEPSADDVATVILHTRQLLPTG

SEQ ID NO: 557 - protein, 26 aa
LLRQGLGNRAPPEPYSHRGGPGQQGA

SEQ ID NO: 558 - protein, 22 aa
GPGGVRLGSVGVGDAPGAHGDV

SEQ ID NO: 559 - protein, 21 aa
TPGPLPCGVTPLVALRGGVVR

SEQ ID NO: 560 - protein, 60 aa
MASRWARGESLSVRVCNHRRRPQWATQRSSLLYQAVQALLDGNCAGQHAGLRGNLTSSRL

SEQ ID NO: 561 - protein, 13 aa
HPEGGTLRDVGVG

SEQ ID NO: 562 - protein, 29 aa
GGGDPYPRGDQAHVLLQTASPANSFSSCS

SEQ ID NO: 563 - protein, 4 aa
ALLR

SEQ ID NO: 564 - protein, 8 aa
WHSGLLGG

SEQ ID NO: 565 - protein, 16 aa
RESAGHGLRSGPKCYH

SEQ ID NO: 566 - protein, 18 aa
WGALHPSAPVADAECGAL

SEQ ID NO: 567 - protein, 9 aa
GQHRDRDGD

SEQ ID NO: 568 - protein, 5 aa
RLRTD

SEQ ID NO: 569 - protein, 38 aa
GRFATSGCCPPSDRECCENSRTAHRCXHGGLQYTLSLW

SEQ ID NO: 570 - protein, 27 aa
PRDACVGRRHTPHSIACTYLGYGEQLR

SEQ ID NO: 571 - protein, 18 aa
EDPVGDLLAGGHPVLRLI

SEQ ID NO: 572 - protein, 5 aa
SHPRV

SEQ ID NO: 573 - protein, 28 aa
IRGKRLQRGSFRTKSLISTERCHTKANG

SEQ ID NO: 574 - protein, 5 aa
DVLLC

SEQ ID NO: 575 - protein, 14 aa
EERNTLLFFRVDRG

SEQ ID NO: 576 - protein, 10 aa
DGDPEPYSLL

SEQ ID NO: 577 - protein, 16 aa
QGAHSARIASWVLGGQ

SEQ ID NO: 578 - protein, 55 aa
GTPRDPCLLLLHMVRGPTYSGHSGQTTSGEAGGVLVGGRHHQGLRDQSGQCWEEG

SEQ ID NO: 579 - protein, 36 aa
QGDFLARSSGTRQVPRGLDRARSESCSRLPKHGLHL

SEQ ID NO: 580 - protein, 6 aa
GGNKDC

SEQ ID NO: 581 - protein, 9 aa
AACCHGLGI

SEQ ID NO: 582 - protein, 16 aa
GVGQGLGHPCGEDGCS

SEQ ID NO: 583 - protein, 6 aa
PASGDT

SEQ ID NO: 584 - protein, 19 aa
RDSGPFYPDCQKGGVLQRS

SEQ ID NO: 585 - protein, 18 aa
GGEGPPPHCVPPPGLPDS

SEQ ID NO: 586 - protein, 29 aa
KAHSGRPGAGCKGRCWGGLRLPVHPQPAG

SEQ ID NO: 587 - protein, 24 aa
GDAKAVGIKEDPVRHLCGCHLLRQ

SEQ ID NO: 588 - protein, 45 aa
XGRGTRDRALRPGLGPSRMGARPGEIXCLWHNGDPGRGASGREVL

SEQ ID NO: 589 - protein, 9 aa
VLGCVDHKC

SEQ ID NO: 590 - protein, 13 aa
QLFDLLHQSESRL

SEQ ID NO: 591 - protein, 14 aa
EDRTEKCLASHRGR

SEQ ID NO: 592 - protein, 27 aa
LLNCVREACMRPLRGPGPNPGFVRVRV

SEQ ID NO: 593 - protein, 18 aa
ALVSRFTGHSPLLLHLAR

SEQ ID NO: 594 - protein, 27 aa
VQCGWXKAFLPDHGLSETTRSHVERVQ

SEQ ID NO: 595 - protein, 39 aa
PYGFGHWLHSPLPLXSHHTVGHHPACANMRFFPGWWHXV

SEQ ID NO: 596 - protein, 8 aa
SGLVSGSW

SEQ ID NO: 597 - protein, 10 aa
LLQVSPGQTA

SEQ ID NO: 598 - protein, 60 aa
HHRGPPRTSSVEGYRRHNQNKDGGWEGSERPQAPWSSRPPQEGRGIANTHAPVARLGGVG

SEQ ID NO: 599 - protein, 13 aa
GPVVASRTPASSP

SEQ ID NO: 600 - protein, 47 aa
DCWYPRGFPSVPPLHGGGSSIGFHSXAESLAVVGVLSPAHRSALWVN

SEQ ID NO: 601 - protein, 18 aa
IHLLRPESDLSPVQKGIE

SEQ ID NO: 602 - DNA (genomic), 36 bp; single-stranded, linear
gccgctgaattcatgccttgttatttctactcaaac

SEQ ID NO: 603 - DNA (genomic), 33 bp; single-stranded, linear
gccgcaggatcctcgaacgaccgctcctgccac

SEQ ID NO: 604 - DNA (genomic), 34 bp; single-stranded, linear
gccgcaggaattcatggcttggctgtggttgctg

SEQ ID NO: 605 - protein, 507 aa
YSTYGMYLTGRCSRNYDVIICDECHATDRTTVLGIGKVLTEAPSKNVRLVVLATATPPGVIPTPHANITEIQLTDEGTIPFHGKKIKEENLKKGRHLIFEATKKHCDELANELARKGITAVSYYRGCDISKMPEGDCVVVATDALCTGYTGDFDSVYDCSLMVEGTCHVDLDPTFTMGVRVCGVSAIVKGQRRGRTGRGRAGIYYYVDGSCTPSGMVPECNIVEAFDAAKAWYGLSSTEAQTILDTYRTQPGLPAIGANLDEWADLFSMVNPEPSFVNTAKRTADNYVLLTAAQLQLCHQYGYAAPNDAPRWQGARLGKKPCGVLWRLDGCDACPGPEPSEVTRYQMCFTEVNTSGTAALAVGVGVAMAYLAIDTFGATCVRRCWSITSVPTGATVAPVVDEEEIVEECASFIPLEAMVAAIDKLKSTITTTSPFTLETALEKLNTFLGPHAATILAIIEYCCGLVTLPDNPFASCVFAFIAGITTPLPHKIKMFLSLFGGAIASKL

SEQ ID NO: 606 - protein, 522 aa
CQKGYKGPWIGSGMLQARCPCGAELIFSVENGFAKLYKGPRTCSNYWRGAVPVNARLCGSARPDPTDWTSLVVNYGVRDYCKYEKLGDHIFVTAVSSPNVCFTQVPPTLRAAVAVDRVQVQXYLGEPKTPWTTSACCYGPDGKGKTVKLPFRVDGHTPGGRMQLNLRDRLEANDCNSINNTPSDEAAVSALVFKQELRRTNQLLEAISAGVDTTKLPAPSQIEEVVVRKRQFRARTGSLTLPPPPRSVPGVSCPESLQRSDPLEGPSXLPSSPPVLQLAMPMPLLGAGECNPFTAIGCAMTETXGXPXXLPSYPPKKEVSEWSDESWSTTTTASSYVTGPPYPKIRGKDSTQSATAKRPTKKKLGKSEFSCSMSYTWTDVISFKTASKVLSATRAITSGFLKQRSLVYVTEPRDAELRKQKVTINRQPLFPPSYHKQVRLAKEKASKVVGVMWDYDEVAAHTPSKSAKSHITGLRGTDVLDLQKCVEAGEIPSHYRQTVIVPKEEVFVKTPQKPTKKPPRLI

SEQ ID NO: 607 - protein, 118 aa
MPVISTQTSPVPAPRTRKNKQTQASYPVSIKTSVERGQRAXRKVQRDARPRNYKIAGIHDGLQTLAQAALPAHGWGRQDPRHKSRNLGILLDYPLGWIGDVTTHTPLVGPLVAGAVVR

SEQ ID NO: 608 - protein, 343 aa
GSGWTDEDERDLVETKAAAIEAIGAALHLPSPEAAQAALEALEEAAVSLLPHVPVIMGDDCSCRDEAFQGHFIPEPNVTEVPIEPTVGDVEALKLRAADLTARLQDLEAMALARAESIEDARAASMPSLTEVDSMPSLESSPCSSFEQISLTESDPETVVEAGXPLEFVNSNTGXSPARRIVRIRQACCCDRSTMKAMPLSFTVGECLFVTRYDPDGHQLFDERGPIEVSTPICEVIGDIRLQCDQIEETPTSYSYIWSGAPLGTGRSVPQPMTRPIGTHLTCDTTKVYVTDPDRAAERAEKVTIWRGDRKYDKHYEAVVEAVLKKAAATKSHGWTYSQAIAK

SEQ ID NO: 609 - protein, 222 aa
YSQAIAKVRRRAAAGYGSKVTASTLATGWPHVEEMLDKIARGQEVPFTFVTKREVFFSKTTRKPPRFIVFPPLDFRIAEKMILGDPGIVAKSILGDAYLFQYTPNQRVKALVKAWEGKLHPAAITVXATCFDSSIDEHDMQVEASVFAAASDNPSMVHALCKYYSGGPMVSPDGVPLGYRQCRSSGVLTTSSANSITCYIKVSAACRRVGIKAPSFFIAGDD

SEQ ID NO: 610 - DNA (genomic), 33 bp; single-stranded, linear
ggggccgaattctacagcacatatggcatgtac

SEQ ID NO: 611 - DNA (genomic), 38 bp; single-stranded, linear
ggggaaaagcttattagtgttttttggtagcctcaaag

SEQ ID NO: 612 - DNA (genomic), 34 bp; single-stranded, linear
ggggccgaattcatctttgaggctaccaaaaaac

SEQ ID NO: 613 - DNA (genomic), 38 bp; single-stranded, linear
ggggaaaagcttattaatagtagtatatgccagctctc

SEQ ID NO: 614 - DNA (genomic), 33 bp; single-stranded, linear
ggggccgaattcgggagagctggcatatactac

SEQ ID NO: 615 - DNA (genomic), 37 bp; single-stranded, linear
ggggaaaagcttattagtcattgggagcagcatagcc

SEQ ID NO: 616 - DNA (genomic), 34 bp; single-stranded, linear
ggggccgaattctatggctatgctgctcccaatg

SEQ ID NO: 617 - DNA (genomic), 37 bp; single-stranded, linear
ggggaaaagcttattatgcacactcctccacgatttc

SEQ ID NO: 618 - DNA (genomic), 33 bp; single-stranded, linear
ggggccgaattcgaggaaatcgtggaggagtgt

SEQ ID NO: 619 - DNA (genomic), 37 bp; single-stranded, linear
ggggaaaagcttattacttggacgcaattgcgcctcc

SEQ ID NO: 620 - DNA (genomic), 33 bp; single-stranded, linear
ggggccgaattctcagcaatagttaaaggccag

SEQ ID NO: 621 - DNA (genomic), 38 bp; single-stranded, linear
ggggaaaagcttattaatttgctcctatcgcaggtaac

SEQ ID NO: 622 - DNA (genomic), 33 bp; single-stranded, linear
ggggccgaattccctgggttacctgcgatagga

SEQ ID NO: 623 - DNA (genomic), 38 bp; single-stranded, linear
ggggaaaagcttattacagaaccccacaaggttttttc

SEQ ID NO: 624 - DNA (genomic), 33 bp; single-stranded, linear
ggggaagaattctgccagaaggggtacaagggc

SEQ ID NO: 625 - DNA (genomic), 36 bp; single-stranded, linear
ggaaaaggatccttaacagcaagcagatgtcgtcca

SEQ ID NO: 626 - DNA (genomic), 33 bp; single-stranded, linear
ggggaagaattcactccttggacgacatctgct

SEQ ID NO: 627 - DNA (genomic), 36 bp; single-stranded, linear
ggaaaaggatccttaaccttctaacgggtcacttcg

SEQ ID NO: 628 - DNA (genomic), 33 bp; single-stranded, linear
ggggaagaattcctgcaacgaagtgacccgtta

SEQ ID NO: 629 - DNA (genomic), 36 bp; single-stranded, linear
ggggaaggatccttaagttgcagacagaactttaga

SEQ ID NO: 630 - DNA (genomic), 33 bp; single-stranded, linear
ggggccgaattcactgcttctaaagttctgtct

SEQ ID NO: 631 - DNA (genomic), 36 bp; single-stranded, linear
ggaaaaggatccttagataagccttgggggtttctt

SEQ ID NO: 632 - DNA (genomic), 33 bp; single-stranded, linear
ggggaagaattctacggtcctgacggtaagggt

SEQ ID NO: 633 - DNA (genomic), 36 bp; single-stranded, linear
ggaaaaggatccttagtcaacgccagctgaaattgc

SEQ ID NO: 634 - DNA (genomic), 33 bp; single-stranded, linear
ggggaagaattccttgaggcaatttcagctggc

SEQ ID NO: 635 - DNA (genomic), 36 bp; single-stranded, linear
ggaaaaggatccttacaactgcagaacaggtggtga

SEQ ID NO: 636 - DNA (genomic), 33 bp; single-stranded, linear
ggaaaaggatccagtgacgcttggtgcctggtc

SEQ ID NO: 637 - DNA (genomic), 34 bp; single-stranded, linear
ggggaaaagcttaaagtttattgtacaggaaccg

SEQ ID NO: 638 - DNA (genomic), 33 bp; single-stranded, linear
ggggaagaattccggctaggtcggttcctgtac

SEQ ID NO: 639 - DNA (genomic), 36 bp; single-stranded, linear
ggaaaaggatccttatgtcccatgcacgaccacagc

SEQ ID NO: 640 - DNA (genomic), 33 bp; single-stranded, linear
ggggaagaattctggtttgaggctgtggtcgtg

SEQ ID NO: 641 - DNA (genomic), 36 bp; single-stranded, linear
ggaaaaggatccttacaaggccgccccaatggcctc

SEQ ID NO: 642 - DNA (genomic), 33 bp; single-stranded, linear
ggggaagaattcgccgccatcgaggccattggg

SEQ ID NO: 643 - DNA (genomic), 37 bp; single-stranded, linear
ggaaaaggatccttacacctcggtgagcgaaggcatc

SEQ ID NO: 644 - DNA (genomic), 33 bp; single-stranded, linear
ggggaagaattcgcagcttcgatgccttcgctc

SEQ ID NO: 645 - DNA (genomic), 38 bp; single-stranded, linear
ggaaaaggatccttaaatcacttcacatataggagtag

SEQ ID NO: 646 - DNA (genomic), 34 bp; single-stranded, linear
ggggaagaattcgaggtatctactcctatatgtg

SEQ ID NO: 647 - DNA (genomic), 37 bp; single-stranded, linear
ggaaaaggatccttatttagctatagcctgggaatag

SEQ ID NO: 648 - DNA (genomic), 24 bp; double-stranded, linear
catcagctctgaacaccgccgcac

SEQ ID NO: 649 - DNA (genomic), 25 bp; double-stranded, linear
gccgagaagcatgcagttgttaagg

SEQ ID NO: 650 - DNA (genomic), 22 bp; double-stranded, linear
gccagctgttcagtccatctcc

SEQ ID NO: 651 - DNA (genomic), 24 bp; double-stranded, linear
ctctactgcacacgtcaggttcgg

SEQ ID NO: 652 - DNA (genomic), 21 bp; double-stranded, linear
ccagagccaccaggcatccgc

SEQ ID NO: 653 - DNA (genomic), 25 bp; double-stranded, linear
caggcagaagcctatgtcctccagg

SEQ ID NO: 654 - DNA (genomic), 24 bp; double-stranded, linear
gtggtagtagccgagagatgcctg

SEQ ID NO: 655 - DNA (genomic), 25 bp; double-stranded, linear
cactccatcgcctgcacttatctcg

SEQ ID NO: 656 - DNA (genomic), 25 bp; double-stranded, linear
ctcgaattgcaagttgggtgcttgg

SEQ ID NO: 657 - DNA (genomic), 23 bp; double-stranded, linear
gaatgtgacaagtgtgaggcacg

SEQ ID NO: 658 - DNA (genomic), 24 bp; double-stranded, linear
ggagatgctaaagctgtgggaatc

SEQ ID NO: 659 - DNA (genomic), 24 bp; double-stranded, linear
gaggacgtggcactagagacagag

SEQ ID NO: 660 - DNA (genomic), 34 bp; double-stranded, linear
cagttcaagcttgtccaggaattcnnnnngcgca

SEQ ID NO: 661 - DNA (genomic), 25 bp; double-stranded, linear
gcttcggccattggttacattctcc

SEQ ID NO: 662 - DNA (genomic), 24 bp; double-stranded, linear
ggtcatcatcccgcatgtgctaac

SEQ ID NO: 663 - DNA (genomic), 21 bp; double-stranded, linear
gggatttaggaccaagacctc

SEQ ID NO: 664 - DNA (genomic), 23 bp; double-stranded, linear
ccaaaagtcgaaaggcaccttcc

SEQ ID NO: 665 - DNA (genomic), 22 bp; double-stranded, linear
caaccgtgcctctgccagcttc

SEQ ID NO: 666 - DNA (genomic), 21 bp; double-stranded, linear
tygcyackgckacccchcckg

SEQ ID NO: 667 - DNA (genomic), 19 bp; double-stranded, linear
tgccmgctytcccmckgcc

SEQ ID NO: 668 - DNA (genomic), 5091 bp; double-stranded, linear
tacgtttgggttcttcccaggagtccccccccttaacaactgcatgcttctcggcactgaggtgtcagaggtattgggtggggcgggcctcactggggggttttacgaacctctggtgcggcggtgttcagagctgatgggtcggcggaatccggtctgcccggggtttgcatggctctcttcgggacggcctgatgggttcatacatgttcagggccacttgcaggaggtggatgcgggcaacttcattccgcccccacgctggttgctcttggactttgtatttgtcctgttatacctgatgaagctggcagaggcacggttggtcccgctgatcctcctcctgctatggtggtgggtgaaccagttggcggtccttgktgtgscggctgckcrcgccgccgtggctggagaggtgtttgcgggccctgccttgtcctggtgtctgggcctacccttcgtgagtatgatcctggggctagcaaacctggtgttgtacttccgctggatgggtcctcaacgcctgatgttcctcgtgttgtggaagctcgctcggggggctttcccgctggcattactgatggggatttccgccactcgcggccgcacctctgtgcttggcgccgaattctgctttgatgtcacctttgaagtggacacgtcagtcttgggttgggtggttgctagtgtggtggcttgggccatagcgctcctgagctctatgagcgcgggggggtggaagcacaaagccataatctataggacgtggtgtaaagggtaccaggcycttcgccagcgcgtggtgcgtagccccctcgggaggggcggcccaccaagccgctgacgatargcctggtgtctggcctcttacatctggccggacgctgtgatgttggtggttgtggccatggtcctcctcttcggccttttcgacgcgctcgattgggccttggaggagctccttgtgtcgcggccttcgttgcgtcgtttggcaagggtggtggagtgttgtgtgatggcgggcgagaaggccactaccgtccggcttgtgtccaagatgtgcgcgagaggggcctacctgtttgaccacatggggtcgttctcgcgcgcggtcaaggagcgcttgctggagtgggacgcggctttggagmccctgtcattcactaggacggactgtcgcatcatacgagacgccgccagaccctgagctgcggccaatgcgtcatgggcttgcgtggtggctaggcgcggcgatgaggtcctgattggggtctttcaggatgtgaaccacttgcctccggggtttgytcctacagcgcctgttgtcatccgtcggtgcggaaagggcttcctcggggtcactaaggctgccttgactggtcgggatcctgacttacacccaggaaacgtcatggttttggggacggctacctcgcgcagcatgggaacgtgcttaaacgggttgctgttcacgacattccatggggcttcttcccgaaccattgcgacacctgtgggggcccttaacccaaggtggtggtcggccagtgatgacgtcacggtctatcccctccccgatggagctaactcgttggttccctgctcgtgtcaggctgagtcctgttgggtcatycgatccgatggggctctttgccatggcttgagcaagggggacaaggtagaactggacgtggccatggaggttgctgactttcgtgggtcgtctgggtctcctgtcctatgcgacgaggggcacgctgtaggaatgctcgtgtccgtccttcattcgggggggagggtgaccgcggctcgattcactcggccgtggacccaagtcccaacagacgccaagactaccactgagccacccccggtgccagctaaaggggttttcaaagaggctcctcttttcatgccaacaggggcggggaaaagcacacgcgtccctttggagtatggaaacatggggcacaaggtcctgattctcaacccgtcggttgccactgtgagggccatgggcccttacatggagaggctggcggggaaacatcctagcattttctgtggacacgacacaacagctttcacacggatcacggactctccattgacgtactctacctatgggaggtttctggccaacccgaggcagatgctgaggggagtttccgtggtcatctgtgatgagtgccacagtcatgactcaactgtgttgctgggtataggcagggtcagggacgtggcgcgggggtgtggagtgcaattagtgctctagcctactgcgactcccccgggctcgcctatgactcagcatccatccataattgagacaaagctggacgttggtgagatccccttttatgggcatggtatccccctcgagcgtatgaggactggtcgccaccttgtattctgccattccaaggcggagtgcgagagattggccggccagttctccgcgcggggggttaatgccatcgcctattataggggtaaggacagttccatcatcaaagacggagacctggtggtttgtgcgacagacgcgctctctaccgggtacacaggaaacttcgattctgtcaccgactgtgggttggtggtggaggaggtcgttgaggtgacccttgatcccaccattaccatttccttgcggactgtccctgcttcggctgaattgtcgatgcagcggcgcggacgcacggggagaggtcggtcgggccgctactactacgctggggtcggtaaggctcccgcgggggtggtgcggtctggtccggtctggtcggcagtggaagctggagtgacctggtatggaatggaacctgacttgacagcaaaccttctgagactttacgacgactgcccttacaccgcagccgtcgcagctgacattggtgaagccgcggtgttctttgcgggcctcgcgcccctcaggatgcatcccgatgttagctgggcaaaagttcgcggcgtcaattggcccctcctggtgggtgttcagcggacgatgtgtcgggaaacactgtctcccggcccgtcggacgaccctcagtgggcaggtctgaaaggcccgaatcctgtcccactactgctgaggtggggcaatgatttgccatcaaaagtggccggccaccacatagttgacgatctggtccgtcggctcggtgtggcggagggatacgtgcgctgtgatgctggrcccatcctcatggtgggcttggccatagcgggcggcatgatctacgcctcttacactgggtcgctagtggtggtaacagactgggatgtgaagggaggtggcaatcccctttataggagtggtgaccaggccacccctcaacccgtggtgcaggtccccccggtagaccatcggccggggggggagtctgcgccacgggatgccaagacagtgacagatgcggtggcagccatccaggtgaactgcgattggtctgtgatgaccctgtcgatcggggaagtcctcaccttggctcaggctaagacagccgaggcctacgcagctacttccaggtggctcgctggctgctacacggggacgcgggccgtccccactgtatcaattgttgacaagctcttcgccgggggttgggccgccgtggtgggtcactgtcacagcgtcattgctgcggcggtggctgcctatggagcttctcgaagtcctccactggccgcggcggcgtcctacctcatggggttgggcgtcggaggcaacgcacaggcgcgcttggcttcagctcttctactgggggctgctgggtacggctctgggggacccctgtcagtgggactcaccatggcgggggccttcatgggacaggtgccagcgtgtcccctccctcgtcactgtcctacttggggctgtgggaggttgggagggcgttgtcaacgctgccagtctcgtcttcgacttcatggctgggaaactttcaacagaagacctttggtatgccatcccggtactcactagtcctggrgcgggcctcgcggggattgcccttggtctggttttgtactcagcaaacaactctggcactaccacatggctgaaccgtctgctgacgacgttgccacggtcatcttgcatacccgacagctacttccaacaggctgactactgcgacaaggtctcggcaatcgtgcgccgcctgagccttactcgcaccgtggtggccctggtcaacagggagcctaaggtggatgaggtccaggtggggtacgtctgggatctgtgggagtgggtgatgcgccaggtgcgcatggtgatgtctagactccgggccctctgccctgtggtgtcactccccttgtggcactgcggggaggggtggtccggtgaatggcttctcgatgggcacgtggagagtcgttgtctgtgcgggtgtgtaatcaccggcgacgtcctcaatgggcaactcaaagatccagtttactctaccaagctgtgcaggcactactggatgggaactgtgccggtcaacatgctgggctacggggaaacctcacctcttctcgcctctgacaccccgaaggtggtacccttcgggacgtcggggtgggctgaggtggtggtgacccctacccacgtggtgatcaggcgcacgtcctgttacaaactgcttcgccagcaaattctttcagcagctgtagctgagccctactacgttgatggcattccggtctcttgggaggctgacgcgagagcgccggccatggtctacggtccgggccaaagtgttaccattgatggggagcgctacacccttccgcaccagttgcggatgcggaatgtggcgccctctgaggtttcatctgaggtcagcatcgagatcgggacggagactgaagactcagaactgactgaggccgatttgccaccagcggctgctgccctccaagcgatagagaatgctgcgagaattctcgaaccgcacatcgatgtcaycatggaggattgcagtacaccctctctctgtggtagtagccgagagatgcctgtgtggggagaagacataccccgcactccatcgcctgcacttatctcggttacggagagcagctcagatgaga

SEQ ID NO: 669 - DNA (genomic), 373 bp; double-stranded, linear
tcgccactgctacccctccgggctccgtcactgtgtcccatcctaacatcgaggaggttgctctgtccaccaccggagagatccccttttacggcaaggctatccccctcgaggtgatcaaggggggaagacatctcatcttctgccactcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagactgcaacacgtgtgtcactcagacagtcgattttagccttgaccctacctt

SEQ ID NO: 670 - DNA (genomic), 20 bp; double-stranded, linear
gacgttggtgagatcccctt

SEQ ID NO: 671 - DNA (genomic), 19 bp; double-stranded, linear
cgaagtttcctgtgtaccc

SEQ ID NO: 672 - DNA (genomic), 156 bp; double-stranded, linear
atccccttttatgggcatggcatacccctggagaggatgcggaccggcaggcacctcgtaatccccttttatgggcatggcatacccctggagaggatgcggaccggcaggcacctcgtaaatgccattgcctattatagggggaaagacagttct

SEQ ID NO: 673 - DNA (genomic), 156 bp; double-stranded, linear
atccccttttatgggcatggaatccccctcgagcggatgcggaccgggcgccacctcgtgttctgccattcaaaggcggagtgcgagcggttggctggccagttctcttcgcggggggtgaatgccattgcctattacagggggaaagacagttcc

SEQ ID NO: 674 - DNA (genomic), 23 bp; double-stranded, linear
ccaatctctcgcactccgccttg

SEQ ID NO: 675 - DNA (genomic), 24 bp; double-stranded, linear
ctcaccaacgtccagctttgtctc

SEQ ID NO: 676 - DNA (genomic), 24 bp; double-stranded, linear
ctcgtatgatgcgacagtccgtcc

SEQ ID NO: 677 - DNA (genomic), 24 bp; double-stranded, linear
gtagtggccttctcgcccgccatc

SEQ ID NO: 678 - DNA (genomic), 23 bp; double-stranded, linear
cactccaccacccttgccaaacg

SEQ ID NO: 679 - DNA (genomic), 24 bp; double-stranded, linear
cctggtaccctttacaccacgtcc

SEQ ID NO: 680 - DNA (genomic), 25 bp; double-stranded, linear
gattatggcctttgtgcttccaccc

SEQ ID NO: 681 - DNA (genomic), 25 bp; double-stranded, linear
ctccaaagccgcgtcccactccagc

SEQ ID NO: 682 - DNA (genomic), 26 bp; double-stranded, linear
catcatcaaagacggagacctggtgg

SEQ ID NO: 683 - DNA (genomic), 25 bp; double-stranded, linear
gcatgatctacgcctcttacactgg

SEQ ID NO: 684 - DNA (genomic), 25 bp; double-stranded, linear
gtcgctagtggtggtaacagactgg

SEQ ID NO: 685 - DNA (genomic), 25 bp; double-stranded, linear
ggtgcgcatggtgatgtctagactc

SEQ ID NO: 686 - DNA (genomic), 25 bp; double-stranded, linear
ggtccggtgaatggcttctcgatgg

SEQ ID NO: 687 - DNA (genomic), 23 bp; double-stranded, linear
accagttgcggatgcggaatgtg

SEQ ID NO: 688 - DNA (genomic), 24 bp; double-stranded, linear
gcatcgagatcgggacggagactg

SEQ ID NO: 689 - DNA (genomic), 34 bp; double-stranded, linear
cagttcaagcttgtccaggaattcnnnnnggcca

SEQ ID NO: 690 - DNA (genomic), 34 bp; double-stranded, linear
cagttcaagcttgtccaggaattcnnnnnccgga

SEQ ID NO: 691 - DNA (genomic), 24 bp; double-stranded, linear
catcagctctgaacaccgccgcac

SEQ ID NO: 692 - DNA (genomic), 25 bp; double-stranded, linear
gccgagaagcatgcagttgttaagg

SEQ ID NO: 693 - DNA (genomic), 22 bp; double-stranded, linear
gccagctgttcagtccatctcc

SEQ ID NO: 694 - DNA (genomic), 24 bp; double-stranded, linear
ctctactgcacacgtcaggttcgg

SEQ ID NO: 695 - DNA (genomic), 21 bp; double-stranded, linear
ccagagccaccaggcatccgc

SEQ ID NO: 696 - DNA (genomic), 25 bp; double-stranded, linear
caggcagaagcctatgtcctccagg

SEQ ID NO: 697 - DNA (genomic), 24 bp; double-stranded, linear
gtggtagtagccgagagatgcctg

SEQ ID NO: 698 - DNA (genomic), 25 bp; double-stranded, linear
cactccatcgcctgcacttatctcg

SEQ ID NO: 699 - DNA (genomic), 25 bp; double-stranded, linear
ctcgaattgcaagttgggtgcttgg

SEQ ID NO: 700 - DNA (genomic), 23 bp; double-stranded, linear
gaatgtgacaagtgtgaggcacg

SEQ ID NO: 701 - DNA (genomic), 24 bp; double-stranded, linear
ggagatgctaaagctgtgggaatc

SEQ ID NO: 702 - DNA (genomic), 24 bp; double-stranded, linear
gaggacgtggcactagagacagag

SEQ ID NO: 703 - DNA (genomic), 36 bp; single-stranded, linear; identical to SEQ ID NO: 602

SEQ ID NO: 704 - DNA (genomic), 33 bp; single-stranded, linear; identical to SEQ ID NO: 603

SEQ ID NO: 705 - DNA (genomic), 34 bp; single-stranded, linear; identical to SEQ ID NO: 604

SEQ ID NO: 706 - DNA (genomic), 20 bp; single-stranded, linear
  Modified site 3: /label= N /note= "N = Inosine"
  Modified site 6: /label= N /note= "N = Inosine"
  Modified site 9: /label= N /note= "N = Inosine"
gcnacngcnacnccnccngg

SEQ ID NO: 707 - DNA (genomic), 21 bp; single-stranded, linear
  Modified site 6: /label= N /note= "N = Inosine"
  Modified site 8: /label= N /note= "N = Inosine"
  Modified site 9: /label= N /note= "N = Inosine"
atggtnanngtnggrtcharr

SEQ ID NO: 708 - DNA (genomic), 22 bp; single-stranded, linear
atgggcatggcatccccctgga

SEQ ID NO: 709 - DNA (genomic), 20 bp; single-stranded, linear
tccttgatgattgaactgtc

SEQ ID NO: 710 - DNA (genomic), 19 bp; single-stranded, linear
ggcacctcgtgttctgcca

SEQ ID NO: 711 - DNA (genomic), 20 bp; single-stranded, linear
aggtctccgtccttgatgat

SEQ ID NO: 712 - DNA (genomic), 199 bp; double-stranded, linear
ttatgggcatggcatccccctggagcggatgaggaccggtaggcacctggtattctgccactcaaaggcggagtgtgagaggctggccggccaattctcctcacggggggttaatgctgttgcctattataggggtaaggacagttcaatcatcaaggatggtgacctggtggtgtgcgctactgacgcgctatctacc

SEQ ID NO: 713 - DNA (genomic), 199 bp; double-stranded, linear
ttatgggcatggcatacctctcgaacggatgcggaccggaaggcacctcgtgttctgccattcaaaggcggagtgcgagcggctcgctggtcagttttctgcgaggggggtaaacgccattgcttattataggggcaaagacagttccatcatcaaggacggagacctagtggtgtgcgccacagacgcgctatccacg

SEQ ID NO: 714 - DNA (genomic), 199 bp; double-stranded, linear
ttatgggcatggcattcctctggagcggatgcagaccggtagacatcttgtgttccgccactcgaaggcggagtgcgagcggcttgccggccagttctcctctaggggggtcaacgccattgcctattacaggggtaaggacagctccatcatcaaggacggagacctcgttgtgtgcgccactgatgcgctctctacg

SEQ ID NO: 715 - DNA (genomic), 199 bp; double-stranded, linear
ttatgggcatggcatacccctcgaacggatgcgaaccggagggcacctcgtgttctgtcattccaaggcggagtgcgagcggcttgctggccagttctctgcgaggggggtgaatgccattgcctattataggggcaaagacagttccatcatcaaggatggcgacctggtggtgtgcgctacgcacgcgctatccacc

SEQ ID NO: 716 - protein, 5 aa
VLEMD

What is claimed is:

1. A purified hepatitis GB viral polypeptide comprising an amino acid sequence wherein said sequence is encoded by a positive stranded RNA genome wherein said genome comprises an open reading frame (ORF) encoding a polyprotein, wherein said polyprotein comprises an amino acid sequence comprising SEQ ID NO:387.

2. A recombinant polypeptide comprising an amino acid sequence wherein said sequence is encoded by a positive stranded RNA genome wherein said genome comprises an open reading frame (ORF) encoding a polyprotein, wherein said polyprotein comprises an amino acid sequence comprising SEQ ID NO:387.

3. A synthetic polypeptide comprising a sequence of HGBV encoded by a positive stranded RNA genome wherein said genome comprises an open reading frame (ORF) encoding a polyprotein, wherein said polyprotein comprises an amino acid sequence comprising SEQ ID NO:387.

4. The synthetic polypeptide of claim 3, wherein said synthetic polypeptide is attached to a solid support.

5. A diagnostic reagent comprising a hepatitis GB viral polypeptide, wherein said polypeptide is encoded by a positive stranded RNA genome wherein said genome comprises an open reading frame (ORF) encoding a polyprotein, wherein said polyprotein comprises an amino acid sequence comprising SEQ ID NO:387.

6. A purified hepatitis GB viral polypeptide comprising an amino acid sequence wherein said sequence is encoded by a positive stranded RNA genome wherein said genome comprises an open reading frame (ORF) encoding a polyprotein, wherein said polyprotein comprises an amino acid sequence comprising SEQ ID NO:394.

7. A recombinant polypeptide comprising an amino acid sequence wherein said sequence is encoded by a positive stranded RNA genome wherein said genome comprises an open reading frame (ORF) encoding a polyprotein, wherein said polyprotein comprises an amino acid sequence comprising SEQ ID NO:394.

8. A synthetic polypeptide comprising a sequence of HGBV encoded by a positive stranded RNA genome wherein said genome comprises an open reading frame (ORF) encoding a polyprotein, wherein said polyprotein comprises an amino acid sequence comprising SEQ ID NO:394.

9. The synthetic polypeptide of claim 8, wherein said synthetic polypeptide is attached to a solid support.

10. A diagnostic reagent comprising a hepatitis GB viral polypeptide, wherein said polypeptide is encoded by a positive stranded RNA genome wherein said genome comprises an open reading frame (ORF) encoding a polyprotein, wherein said polyprotein comprises an amino acid sequence comprising SEQ ID NO:394.

* * * * *